United States Patent 7,482,117 (GENETIC POLYMORPHISMS ASSOCIATED WITH MYOCARDIAL INFARCTION, METHODS OF DETECTION AND USES THEREOF) - sequence listing, part 16

SEQ ID NO: 65297 - DNA, 201 bp, Homo sapiens
tgtaattgttgcttcactgtactgcaggtatccccctgtttaaaaaaatgtatgaataccgtgcctcgtgtaatctgctttgaaacacaggttataacctrttggaacctgtgcttcctgggcgcacatcctcaagctcggcctgataaactttgtttgattgagattcccatcttggtctctcaatttgggttgacacag

SEQ ID NO: 65298 - DNA, 201 bp, Homo sapiens
gtgggcgacaccgcgagggcttcccgtttatgggcggccgtccgcgctgtaagatggccagggaagccaacttggctggagatggaggcggcggcgttgtstacgccgcgggagtcagtgaactccgcagggcactgctttttgtgctctacgtgacagaccacgtgcttcgggctgcgaccctggtccttgtccgaatgt

SEQ ID NO: 65299 - DNA, 201 bp, Homo sapiens
gtttatgggcggccgtccgcgctgtaagatggccagggaagccaacttggctggagatggaggcggcggcgttgtgtacgccgcgggagtcagtgaactcygcagggcactgctttttgtgctctacgtgacagaccacgtgcttcgggctgcgaccctggtccttgtccgaatgtccagccccgcgtgagccgtgggatg

SEQ ID NO: 65300 - DNA, 201 bp, Homo sapiens
gtattcatggtaaatgctcaaaacttccccagaggggaatcacgttaatgcaaatgtgcaaaataaaaaggtgtgtcttaaatttaaggatgcatccttarttgtgtacagcttcattattttacaggattgtttgtggcatttcttacttcaaaacctgattttaaaaaatgcttctcttccccatttttagattgcatg

SEQ ID NO: 65301 - DNA, 201 bp, Homo sapiens
aagttgcttgggggtggggtggagcagagagaactctttaatggttccttgttacagccctcaacaaagatatgtcaattcccttggctttacagactatygcccagaagaaaagatgtttggttttcacaagccaaagatgtaccgaagtatagagggctgctgtatttgcagagctaagtcctccagttctcgattcac

SEQ ID NO: 65302 - DNA, 201 bp, Homo sapiens
ctaaagcagaatcaaagctcctcttggggaaatggcaagtctttaggataggcaagaccctgtatgaatagtaccaaagcattaccgcatggtagagaacrcactcgattaaaaatgttaagctatctgaaaaataaaatgtgcaagtcttcaggatggcacaaaacaaaggttaatgcttcttggggcacatttcttaga

SEQ ID NO: 65303 - DNA, 201 bp, Homo sapiens
aaatcagccagtcgtggtggcacacacctgtaatcttagttcctcaggaggctgaggcaggagaattgcttgaacctcagaggcggaggttgcaatgagckgagattgtaccactgcactccagcctggcgacagagtgagactctctcaggaaaaaaaaaaaaaaaaagatcgtagattagattaaaatccagcgatgct

SEQ ID NO: 65304 - DNA, 201 bp, Homo sapiens
gaggttgagactgcagtgagctgtggtcatgccactgcacttcagcctgggtgacagagtgagatccggtctcaaggaaaaccaaaagataaaaataattaaaaaaaaaaaaaaacccaaattttctttagtctgtttctttccatgcagcatgtaacataggatttgatgccttataaatatttaataagtacttgattg

SEQ ID NO: 65305 - DNA, 201 bp, Homo sapiens
aggctgaggcaggagaatcgcctgaacccaggaggtggaggttgcagtgagccgagatcgtgccattgcactccagcctgggcaacgagagcaaaactgcstctcaaaaaaaaagaaaagagtgatcttttcattaaatggtgctgggtgatctacatatccatggggaagagggccagggaagaatctttgacccttacc

SEQ ID NO: 65306 - DNA, 201 bp, Homo sapiens
attggtagtagtgtagtagtaaacactttagaacagtgcctagtgcatagtgtaagtactttaaagtactttaaaccactttgtttgcatttatttaatctttttttttttttttttgagacagagtttcactctgtagcccagactggagtgcagtggtgttatcttggctcactgcaatgtccgcctcctgggctcagg

SEQ ID NO: 65307 - DNA, 201 bp, Homo sapiens
caaccaggctggagtgcagtgcagtggcacggatctcagctcactgcaacctccccctactgggttcaagcgattctcctgcctcagcctcccgagtagcygggattacaggtgcatgccaccacacccagctaatttttgtatttttagtagagacagagtttcgccatgttggccaggctggtcttgaactcctgacct

SEQ ID NO: 65308 - DNA, 201 bp, Homo sapiens
tattctaaagaaccaccagattgcttgaaaaaacaaatctccagtttaaaatcaagttatgccacgcccacccagtactttgttaaatatataaagtaacytggtttcagagaccattttatgtccttggttttgctctagggattaagtagtgttttttttttgttgtttttttaaacatttcatgggtttgtagatttt

SEQ ID NO: 65309 - DNA, 201 bp, Homo sapiens
tattaataaacctatttttcccaagttttggttgaccaaattacaataccaaaaggcaacctatattagtacatttctgtagtaaatagaaagagcatgtyaggaaaatgaaaaactttggacctatttttcccaagttttggttgaccaaattacaataccaaaaggcaacctatattagtacatttctgtattaaatag

SEQ ID NO: 65310 - DNA, 201 bp, Homo sapiens
cattgacagtttcttttttttttttttttttgagacggagttttgctcttgttgccaagctatagtgcaatggctcgatctctgctcactgcagcctctgyctcccgggttcagtgattctcctgccttagcctcccgagtagctgggattacaggtgcatggccaccacacctggctaaatttttgtatttttagtagaa

SEQ ID NO: 65311 - DNA, 201 bp, Homo sapiens
tactttaaagtactttaaaccactttgtttgcatttatttaatctttttttttttttttttgagacagagtttcactctgtagcccagactggagtgcagkggtgttatcttggctcactgcaatgtccgcctcctgggctcaggcaattctcccacctcagccgcccaaatagctgggtctacaggcacgcaccaccatg

SEQ ID NO: 65312 - DNA, 201 bp, Homo sapiens
atgagggagctgagtcagctacgggcaagcgggcagctgaagatgatgaggataacgatgtcgatacccagaagcagaagaccgacgaggatgaccagacrgcaaaaaaggaaaagttaaactaaaaaaaaaaggccgccgtgacctattcgccctccacttcccgtctcagaatctaaacgtggtcaccttcgagtagag

SEQ ID NO: 65313 - DNA, 201 bp, Homo sapiens
aaaaaaaacaactcttaccctcctccaaatctaaggacatttgatgaaaaacattgtcctgccccactggctgctctgaaaagccgtctttgcattgtgcstcgtcagcctccttgctcgccgcagccgcctccgccgccgcggactccggcagctttatcgccagagtccctgaactgtcgctttcttttttatcccctg

SEQ ID NO: 65314 - DNA, 201 bp, Homo sapiens
aggtggggaggaagaaggtgatggtgaggaagaggatggagatgaagatgagggagctgagtcagctacgggcaagcgggcagctgaagatgatgaggatracgatgtcgatacccagaagcagaagaccgacgaggatgaccagacagcaaaaaaggaaaagttaaactaaaaaaaaaaggccgccgtgacctattcgcc

SEQ ID NO: 65315 - DNA, 201 bp, Homo sapiens
actcttaagaactttattccccaggaaaggtgaatttcacagccactgcggaagccatgcattctcaggaagtgtgtgacaatgagttgactgacgtcccrccacttgcgcagaaggacactgtagtcaaggccttactagttgaggtacgtaagtctactctctgtgagtctcagagcccttattatttcatacagtatt

SEQ ID NO: 65316 - DNA, 201 bp, Homo sapiens
cactggggaaactggaaaagaagaaactgttcaatatagaatcaccgtttaactcttaagaactttattccccaggaaaggtgaatttcacagccactgcrgaagccatgcattctcaggaagtgtgtgacaatgagttgactgacgtcccaccacttgcgcagaaggacactgtagtcaaggccttactagttgaggtac

SEQ ID NO: 65317 - DNA, 201 bp, Homo sapiens
aaaagccgtctttgcattgtgcgtcgtcagcctccttgctcgccgcagccgcctccgccgccgcggactccggcagctttatcgccagagtccctgaactstcgctttcttttttatcccctgcatcgcgtcaccggcgtgccccaccatgtcagacgcagccgtagacaccagctccgaaatcaccaccgaggacttaaa

SEQ ID NO: 65318 - DNA, 201 bp, Homo sapiens
ataacgatgtcgatacccagaagcagaagaccgacgaggatgaccagacagcaaaaaaggaaaagttaaactaaaaaaaaaaggccgccgtgacctattcrccctccacttcccgtctcagaatctaaacgtggtcaccttcgagtagagaggcccgcccgcccaccgtgggcagtgccacccgcagatgacacgcgctct

SEQ ID NO: 65319 - DNA, 201 bp, Homo sapiens
gcgctctccaccacccaacccaaaccatgagaatttgcaacaggggagggaaaaagaaccaaaacttccaaggccctgctttttttttttcttaaaagtastttaaaaaggaaacttgtattttttatttacattttatatttttgtacatattgttagggtcggccatttttaatgatctcggatgaccaaaccagcctt

SEQ ID NO: 65320 - DNA, 201 bp, Homo sapiens
aagttgctgtttatttttattttttggcctgtttgatgtatgtgtgaaacaatgttgtccaacaataaacaggaattttattttgctgagttgttctagcaaaaaaaaaaagaaaaaaaaaagaaaaacattgttctgatgaaaatcacttggaatgagcctcttagggaaataaatagaaagtactttttaggataaatt

SEQ ID NO: 65321 - DNA, 201 bp, Homo sapiens
caatatagaatcaccgtttaactcttaagaactttattccccaggaaaggtgaatttcacagccactgcggaagccatgcattctcaggaagtgtgtgacratgagttgactgacgtcccaccacttgcgcagaaggacactgtagtcaaggccttactagttgaggtacgtaagtctactctctgtgagtctcagagccc

SEQ ID NO: 65322 - DNA, 201 bp, Homo sapiens
agacgcagccgtagacaccagctccgaaatcaccaccgaggacttaaaggagaagaaggaagttgtggaagaggcggaaaatggaagagacgcccctgctmacgggaatgctaatgaggaaaatggggagccggaggctgacaacgaggtagatgaagaagaggaagaaggtggggaggaagaaggtgatggtgaggaaga

SEQ ID NO: 65323 - DNA, 201 bp, Homo sapiens
ctgggtgagtagtaatgctattagcaaattccacttcgtgtgcttggatgatttgttttctgcactgaccccaatacacactttttctcctcctttaataytaatcaagaggaagacaaccactggatacactggggaaactggaaaagaagaaactgttcaatatagaatcaccgtttaactcttaagaactttattccc

SEQ ID NO: 65324 - DNA, 201 bp, Homo sapiens
cgcagccgtagacaccagctccgaaatcaccaccgaggacttaaaggagaagaaggaagttgtggaagaggcggaaaatggaagagacgcccctgctcacrggaatgctaatgaggaaaatggggagccggaggctgacaacgaggtagatgaagaagaggaagaaggtggggaggaagaaggtgatggtgaggaagagga

SEQ ID NO: 65325 - DNA, 201 bp, Homo sapiens
ggaaaaccgtgtcctgggttgtgactccgaagtcactgggtgagtagtaatgctattagcaaattccacttcgtgtgcttggatgatttgttttctgcacygaccccaatacacactttttctcctcctttaatattaatcaagaggaagacaaccactggatacactggggaaactggaaaagaagaaactgttcaatat

SEQ ID NO: 65326 - DNA, 201 bp, Homo sapiens
aattttcttgtttcaaacacctaaactacaaagtgtctgatagagctgaccatatttgcacagcttctcagcgcctctggactcatggacattgtccctcwgtccatttacctgatgcacagagcatcttttgcagtattcatgctgttctgcatcccttcataaacttgtggttgggtgtgggggacaggtcgttgtgca

SEQ ID NO: 65327 - DNA, 201 bp, Homo sapiens
cgcagatgacacgcgctctccaccacccaacccaaaccatgagaatttgcaacaggggagggaaaaagaaccaaaacttccaaggccctgctttttttttttcttaaaagtactttaaaaaggaaacttgtattttttatttacattttatatttttgtacatattgttagggtcggccatttttaatgatctcggatgac

SEQ ID NO: 65328 - DNA, 201 bp, Homo sapiens
gcagatgacacgcgctctccaccacccaacccaaaccatgagaatttgcaacaggggagggaaaaagaaccaaaacttccaaggccctgctttttttttttcttaaaagtactttaaaaaggaaacttgtattttttatttacattttatatttttgtacatattgttagggtcggccatttttaatgatctcggatgacc

SEQ ID NO: 65329 - DNA, 201 bp, Homo sapiens
agggtcggccatttttaatgatctcggatgaccaaaccagccttcggagcgttctctgtcctacttctcactttacttgtggtgtggccatgttcattatratctcaaaggagaaaaaaaaaacttgtaaaaaatgcaaaaatgacaacagaaaaaccatcttattccgagcattccagtaacttttttgtgtatgtactt

SEQ ID NO: 65330 - DNA, 201 bp, Homo sapiens
ggaatgctaatgaggaaaatggggagccggaggctgacaacgaggtagatgaagaagaggaagaaggtggggaggaagaaggtgatggtgaggaagaggayggagatgaagatgagggagctgagtcagctacgggcaagcgggcagctgaagatgatgaggataacgatgtcgatacccagaagcagaagaccgacgagg

SEQ ID NO: 65331 - DNA, 201 bp, Homo sapiens
tctctcaaactcaggtggcagaggttgccgtgagccgagatcgcaccactgcactccagcccgggcaacagagcgagactctgtctcaaaaaaaaaaaaaagaagaagataacacatgtagggttttggcttcatgtgtagcagatatttggtcaatggttgcttattttttggcgtcaccatagggagaaatatggttaa

SEQ ID NO: 65332 - DNA, 201 bp, Homo sapiens
ccaaggtgggtggatcgcttgaggtcaggagttcgagaccagcctggccaatatggcaaaaccctgtctctactaaaaatacaaaaaaaattagccgggtrtggtggctcatgcctgtagtcccagctactcgggagactgaggcaggagaatcgcttgaacccgggaggcagaggttgcagtgagccgagatcgcaccac

SEQ ID NO: 65333 - DNA, 201 bp, Homo sapiens
agtgtcaggagggctctggggtcagcctgggtgttaatcccagctctgctgcttgctggccccatgaccttggtatggttacttcacttctctgagcctcrcttttcctgtttgtgaaatggggacaatggcagcatccaccgcatagggttgttacgaaggtcaaggtcgtcacgtgcacgcctggcaccatgcctgtgc

SEQ ID NO: 65334 - DNA, 201 bp, Homo sapiens
aggaagcggaggttgcagtgagctgagatcacgccattgtactgcagcctaggcgacagagcaagactctgtctcaaaaaaaaaaaaaagtatatatatawgctgggtgctgtggctcatgcctgtaatcccagcactttgggaggccaaggtgggtggatcgcttgaggtcaggagttcgagaccagcctggccaatatg

SEQ ID NO: 65335 - DNA, 201 bp, Homo sapiens
gccgggctgccctggctgggggcaggagcacgcctgggcatggggatcctgtccccgtctccttcccctccccctccctccattctcagtcacaggcctcrgggagctgctcagggaggcccaggaggggaggaacagggcttcgtgtgggaggatttctgcaggcagctgggactttcctccccagcttggctggaggcc

SEQ ID NO: 65336 - DNA, 201 bp, Homo sapiens
ttgcttgaacccaggaagcggaggttgcagtgagctgagatcacgccattgtactgcagcctaggcgacagagcaagactctgtctcaaaaaaaaaaaaaagtatatatatatgctgggtgctgtggctcatgcctgtaatcccagcactttgggaggccaaggtgggtggatcgcttgaggtcaggagttcgagaccagc

SEQ ID NO: 65337 - DNA, 201 bp, Homo sapiens
cggccctccactggcgactcagggctgctggcccttccgtggcaggacccactcggcagcagttcacagtgagcagtggcgagagcccaccgctgagcgcyggcaacatctaccagaagaggccggtcctgggcgacatcgtgtcagggcctgtgctcagctgcctcctccacatcgcccgcctgtatggggagcctgtcc

SEQ ID NO: 65338 - DNA, 201 bp, Homo sapiens
tgggaggctgtttactgcctgtagaccgctgagcagagtccatggccctgccgggctgccctggctgggggcaggagcacgcctgggcatggggatcctgyccccgtctccttcccctccccctccctccattctcagtcacaggcctcggggagctgctcagggaggcccaggaggggaggaacagggcttcgtgtggga

SEQ ID NO: 65339 - DNA, 201 bp, Homo sapiens
tgaaccctgggcttgtccgtgccctggccatcagccccagtggccgtagtgtcgtggccggcttctcctcaggcttcatggtgctcctggacacccgcacrggcctggttctgcgaggctggccagcccacgagggggacattctgcagatcaaggtgacgggccgggtctccctccccttgctgcccaacccccgcccct

SEQ ID NO: 65340 - DNA, 201 bp, Homo sapiens
cgctgtacaactacggcgacgggaccagcgagacggccccacgcctcgtctacacccagcaccgcaagagcgtcttcttcgtgggccagcttgaggccccrcagcacgtggtgagctgtgacggggctgtgcacgtctgggaccccttcacaggtgagcgggcccaggtgaggcctgttctcttcctgctcctgcgcccca

SEQ ID NO: 65341 - DNA, 201 bp, Homo sapiens
ctcctgctgggctcagacaacggggttatccgcctcctggcatagactgaggcaggagctggccgggcaagggtgggaagacatctgcgggcgcgtgtccrctcaccctgttccctgagcagcagctccctccagggaggccctgggtcccacgccctgggtgcccacatggcctgccaactagggcctgcaaatggagtg

SEQ ID NO: 65342 - DNA, 201 bp, Homo sapiens
agatcggcgtgagccagcaggatgcccactttcacttccaccagatccgcctgcagagcttcccgggccactcgggggccgtcaagtgcgtggcacccctragcagcgaggacttcttcctgagcggcagcaaggatcgtaccgtgcgcctctggccgctgtacaactacggcgacgggaccagcgagacggccccacgcc

SEQ ID NO: 65343 - DNA, 201 bp, Homo sapiens; identical to SEQ ID NO: 51378

SEQ ID NO: 65344 - DNA, 201 bp, Homo sapiens
cacgagctggttggggagctggcggcgctgtacttggagagcatcagccccagcagtcgcaaccctgccagcgtggagcccaccatgcccggcaccgggcmcgagtgggacccccatggtgggggctgccctcaggatgacggccactcagggacctttgggagcgtcctggtggggaaccgcattcagatccccaatgac

SEQ ID NO: 65345 - DNA, 201 bp, Homo sapiens
gaggctgaggcaagagaattgcttgaacctgggaggtggaggttgcagtgagccgagattgcaccactgcactccagcctgggcgacaaagcgagactccrtctcaaaaaaagagaaacatctttagcattttctaaggatccctgggggacgggaggcaggtgtgcggtgagttgggggattagaagctcccagggctct

SEQ ID NO: 65346 - DNA, 201 bp, Homo sapiens
caggttaaataaagctgagctgggaggctgtttactgcctgtagaccgctgagcagagtccatggccctgccgggctgccctggctgggggcaggagcacrcctgggcatggggatcctgtccccgtctccttcccctccccctccctccattctcagtcacaggcctcggggagctgctcagggaggcccaggaggggag

SEQ ID NO: 65347 - DNA, 201 bp, Homo sapiens
aaaaatatatataaaggccgagcgtggtgtctcacccctgtaatcccagcactttggggggccaaggcgggtggatcacgaggtcaggagtttgagacccrcctggccaacatggtgaaaccccgtctccactaaaaatacaaaatcttcgctgggcatggcagcaggtgcctgcaatcccaggttctcgggaggctgcaa

SEQ ID NO: 65348 - DNA, 201 bp, Homo sapiens
gttgtctgcccacccctaccacagtgtttgtgccttcagctgagggggcagcctctgggccctgaacccctgctggggctccacgaccctgagagaagggktgagaagaatcatctctgcacctcgggtctctgccagaggaagacttaagcatccctgcgacctcacattctagacagagatgaggtccaggggttggcc

SEQ ID NO: 65349 - DNA, 201 bp, Homo sapiens; identical to SEQ ID NO: 39454

SEQ ID NO: 65350 - DNA, 201 bp, Homo sapiens; identical to SEQ ID NO: 42018

SEQ ID NO: 65351 - DNA, 201 bp, Homo sapiens; identical to SEQ ID NO: 40951

SEQ ID NO: 65352 - DNA, 201 bp, Homo sapiens; identical to SEQ ID NO: 42057

SEQ ID NO: 65353 - DNA, 201 bp, Homo sapiens; identical to SEQ ID NO: 42058

SEQ ID NO: 65354 - DNA, 201 bp, Homo sapiens; identical to SEQ ID NO: 40719

SEQ ID NO: 65355 - DNA, 201 bp, Homo sapiens; identical to SEQ ID NO: 40112

SEQ ID NO: 65356 - DNA, 201 bp, Homo sapiens; identical to SEQ ID NO: 42060

SEQ ID NO: 65357 - DNA, 201 bp, Homo sapiens; identical to SEQ ID NO: 40113

SEQ ID NO: 65358 - DNA, 201 bp, Homo sapiens; identical to SEQ ID NO: 40115

SEQ ID NO: 65359 - DNA, 201 bp, Homo sapiens; identical to SEQ ID NO: 42156

SEQ ID NO: 65360 - DNA, 201 bp, Homo sapiens; identical to SEQ ID NO: 42157

SEQ ID NO: 65361 - DNA, 201 bp, Homo sapiens; identical to SEQ ID NO: 39475

SEQ ID NO: 65362 - DNA, 201 bp, Homo sapiens; identical to SEQ ID NO: 39476

SEQ ID NO: 65363 - DNA, 201 bp, Homo sapiens; identical to SEQ ID NO: 39477

SEQ ID NO: 65364 - DNA, 201 bp, Homo sapiens; identical to SEQ ID NO: 39479

SEQ ID NO: 65365 - DNA, 201 bp, Homo sapiens; identical to SEQ ID NO: 39482

SEQ ID NO: 65366 - DNA, 201 bp, Homo sapiens; identical to SEQ ID NO: 39484

SEQ ID NO: 65367 - DNA, 201 bp, Homo sapiens; identical to SEQ ID NO: 42988

SEQ ID NO: 65368 - DNA, 201 bp, Homo sapiens; identical to SEQ ID NO: 39485

SEQ ID NO: 65369 - DNA, 201 bp, Homo sapiens; identical to SEQ ID NO: 42989

SEQ ID NO: 65370 - DNA, 201 bp, Homo sapiens; identical to SEQ ID NO: 39486

SEQ ID NO: 65371 - DNA, 201 bp, Homo sapiens; identical to SEQ ID NO: 42990

SEQ ID NO: 65372 - DNA, 201 bp, Homo sapiens; identical to SEQ ID NO: 39488

SEQ ID NO: 65373 - DNA, 201 bp, Homo sapiens; identical to SEQ ID NO: 42165

SEQ ID NO: 65374 - DNA, 201 bp, Homo sapiens; identical to SEQ ID NO: 42393

SEQ ID NO: 65375 - DNA, 201 bp, Homo sapiens; identical to SEQ ID NO: 39489

SEQ ID NO: 65376 - DNA, 201 bp, Homo sapiens; identical to SEQ ID NO: 39490

SEQ ID NO: 65377 - DNA, 201 bp, Homo sapiens; identical to SEQ ID NO: 39358

SEQ ID NO: 65378 - DNA, 201 bp, Homo sapiens; identical to SEQ ID NO: 39491

SEQ ID NO: 65379 - DNA, 201 bp, Homo sapiens; identical to SEQ ID NO: 42076

SEQ ID NO: 65380 - DNA, 201 bp, Homo sapiens; identical to SEQ ID NO: 42025

SEQ ID NO: 65381 - DNA, 201 bp, Homo sapiens; identical to SEQ ID NO: 42077

SEQ ID NO: 65382 - DNA, 201 bp, Homo sapiens; identical to SEQ ID NO: 39359

SEQ ID NO: 65383 - DNA, 201 bp, Homo sapiens; identical to SEQ ID NO: 39361

SEQ ID NO: 65384 - DNA, 201 bp, Homo sapiens; identical to SEQ ID NO: 39365

SEQ ID NO: 65385 - DNA, 201 bp, Homo sapiens; identical to SEQ ID NO: 39367

SEQ ID NO: 65386 - DNA, 201 bp, Homo sapiens; identical to SEQ ID NO: 39369

SEQ ID NO: 65387 - DNA, 201 bp, Homo sapiens; identical to SEQ ID NO: 39370

SEQ ID NO: 65388 - DNA, 201 bp, Homo sapiens; identical to SEQ ID NO: 42935

SEQ ID NO: 65389 - DNA, 201 bp, Homo sapiens; identical to SEQ ID NO: 39506

SEQ ID NO: 65390 - DNA, 201 bp, Homo sapiens; identical to SEQ ID NO: 43041

SEQ ID NO: 65391 - DNA, 201 bp, Homo sapiens; identical to SEQ ID NO: 42960

SEQ ID NO: 65392 - DNA, 201 bp, Homo sapiens; identical to SEQ ID NO: 41627

SEQ ID NO: 65393 - DNA, 201 bp, Homo sapiens; identical to SEQ ID NO: 39508

SEQ ID NO: 65394 - DNA, 201 bp, Homo sapiens; identical to SEQ ID NO: 41979

SEQ ID NO: 65395 - DNA, 201 bp, Homo sapiens; identical to SEQ ID NO: 39513

SEQ ID NO: 65396 - DNA, 201 bp, Homo sapiens; identical to SEQ ID NO: 42029

SEQ ID NO: 65397 - DNA, 201 bp, Homo sapiens; identical to SEQ ID NO: 39514

SEQ ID NO: 65398 - DNA, 201 bp, Homo sapiens; identical to SEQ ID NO: 42031

SEQ ID NO: 65399 - DNA, 201 bp, Homo sapiens; identical to SEQ ID NO: 39516

SEQ ID NO: 65400 - DNA, 201 bp, Homo sapiens; identical to SEQ ID NO: 41024

SEQ ID NO: 65401 - DNA, 201 bp, Homo sapiens; identical to SEQ ID NO: 39523

SEQ ID NO: 65402 - DNA, 201 bp, Homo sapiens; identical to SEQ ID NO: 41025

SEQ ID NO: 65403 - DNA, 201 bp, Homo sapiens; identical to SEQ ID NO: 39526

SEQ ID NO: 65404 - DNA, 201 bp, Homo sapiens; identical to SEQ ID NO: 39528

SEQ ID NO: 65405 - DNA, 201 bp, Homo sapiens; identical to SEQ ID NO: 39531

SEQ ID NO: 65406 - DNA, 201 bp, Homo sapiens; identical to SEQ ID NO: 39535

SEQ ID NO: 65407 - DNA, 201 bp, Homo sapiens; identical to SEQ ID NO: 41563

SEQ ID NO: 65408 - DNA, 201 bp, Homo sapiens; identical to SEQ ID NO: 43474

SEQ ID NO: 65409 - DNA, 201 bp, Homo sapiens; identical to SEQ ID NO: 39393

SEQ ID NO: 65410 - DNA, 201 bp, Homo sapiens; identical to SEQ ID NO: 40648

SEQ ID NO: 65411 - DNA, 201 bp, Homo sapiens; identical to SEQ ID NO: 41028

SEQ ID NO: 65412 - DNA, 201 bp, Homo sapiens; identical to SEQ ID NO: 42424

SEQ ID NO: 65413 - DNA, 201 bp, Homo sapiens; identical to SEQ ID NO: 41689

SEQ ID NO: 65414 - DNA, 201 bp, Homo sapiens; identical to SEQ ID NO: 42426

SEQ ID NO: 65415 - DNA, 201 bp, Homo sapiens; identical to SEQ ID NO: 42429

SEQ ID NO: 65416 - DNA, 201 bp, Homo sapiens; identical to SEQ ID NO: 42003

SEQ ID NO: 65417 - DNA, 201 bp, Homo sapiens; identical to SEQ ID NO: 42004

SEQ ID NO: 65418 - DNA, 201 bp, Homo sapiens; identical to SEQ ID NO: 42037

SEQ ID NO: 65419 - DNA, 201 bp, Homo sapiens; identical to SEQ ID NO: 42038

SEQ ID NO: 65420 - DNA, 201 bp, Homo sapiens; identical to SEQ ID NO: 40094

SEQ ID NO: 65421 - DNA, 201 bp, Homo sapiens; identical to SEQ ID NO: 38597

SEQ ID NO: 65422 - DNA, 201 bp, Homo sapiens; identical to SEQ ID NO: 40095

SEQ ID NO: 65423 - DNA, 201 bp, Homo sapiens; identical to SEQ ID NO: 41697

SEQ ID NO: 65424 - DNA, 201 bp, Homo sapiens; identical to SEQ ID NO: 41698

SEQ ID NO: 65425 - DNA, 201 bp, Homo sapiens; identical to SEQ ID NO: 43194

SEQ ID NO: 65426 - DNA, 201 bp, Homo sapiens; identical to SEQ ID NO: 41701

SEQ ID NO: 65427 - DNA, 201 bp, Homo sapiens; identical to SEQ ID NO: 38926

SEQ ID NO: 65428 - DNA, 201 bp, Homo sapiens; identical to SEQ ID NO: 42448

SEQ ID NO: 65429 - DNA, 201 bp, Homo sapiens; identical to SEQ ID NO: 38929

SEQ ID NO: 65430 - DNA, 201 bp, Homo sapiens; identical to SEQ ID NO: 42451

SEQ ID NO: 65431 - DNA, 201 bp, Homo sapiens; identical to SEQ ID NO: 42016

SEQ ID NO: 65432 - DNA, 201 bp, Homo sapiens; identical to SEQ ID NO: 42017

SEQ ID NO: 65433 - DNA, 201 bp, Homo sapiens; identical to SEQ ID NO: 40311

SEQ ID NO: 65434 - DNA, 201 bp, Homo sapiens; identical to SEQ ID NO: 41605

SEQ ID NO: 65435 - DNA, 201 bp, Homo sapiens; identical to SEQ ID NO: 40313

SEQ ID NO: 65436 - DNA, 201 bp, Homo sapiens; identical to SEQ ID NO: 40315

SEQ ID NO: 65437 - DNA, 201 bp, Homo sapiens; identical to SEQ ID NO: 40317

SEQ ID NO: 65438 - DNA, 201 bp, Homo sapiens; identical to SEQ ID NO: 40319

SEQ ID NO: 65439 - DNA, 201 bp, Homo sapiens; identical to SEQ ID NO: 40322

SEQ ID NO: 65440 - DNA, 201 bp, Homo sapiens; identical to SEQ ID NO: 37909

SEQ ID NO: 65441 - DNA, 201 bp, Homo sapiens; identical to SEQ ID NO: 38799

SEQ ID NO: 65442 - DNA, 201 bp, Homo sapiens; identical to SEQ ID NO: 37911

SEQ ID NO: 65443 - DNA, 201 bp, Homo sapiens; identical to SEQ ID NO: 38801

SEQ ID NO: 65444 - DNA, 201 bp, Homo sapiens; identical to SEQ ID NO: 38321

SEQ ID NO: 65445 - DNA, 201 bp, Homo sapiens; identical to SEQ ID NO: 37916

SEQ ID NO: 65446 - DNA, 201 bp, Homo sapiens; identical to SEQ ID NO: 38327

SEQ ID NO: 65447 - DNA, 201 bp, Homo sapiens; identical to SEQ ID NO: 42310

SEQ ID NO: 65448 - DNA, 201 bp, Homo sapiens; identical to SEQ ID NO: 40349

SEQ ID NO: 65449 - DNA, 201 bp, Homo sapiens; identical to SEQ ID NO: 40909

SEQ ID NO: 65450 - DNA, 201 bp, Homo sapiens; identical to SEQ ID NO: 40910

SEQ ID NO: 65451 - DNA, 201 bp, Homo sapiens; identical to SEQ ID NO: 40351

SEQ ID NO: 65452 - DNA, 201 bp, Homo sapiens; identical to SEQ ID NO: 40354

SEQ ID NO: 65453 - DNA, 201 bp, Homo sapiens; identical to SEQ ID NO: 40912

SEQ ID NO: 65454 - DNA, 201 bp, Homo sapiens; identical to SEQ ID NO: 40357

SEQ ID NO: 65455 - DNA, 201 bp, Homo sapiens; identical to SEQ ID NO: 40359

SEQ ID NO: 65456 - DNA, 201 bp, Homo sapiens; identical to SEQ ID NO: 40361

SEQ ID NO: 65457 - DNA, 201 bp, Homo sapiens; identical to SEQ ID NO: 40364

SEQ ID NO: 65458 - DNA, 201 bp, Homo sapiens; identical to SEQ ID NO: 40367

SEQ ID NO: 65459 - DNA, 201 bp, Homo sapiens; identical to SEQ ID NO: 40369

SEQ ID NO: 65460 - DNA, 201 bp, Homo sapiens; identical to SEQ ID NO: 40371

SEQ ID NO: 65461 - DNA, 201 bp, Homo sapiens; identical to SEQ ID NO: 42958

SEQ ID NO: 65462 - DNA, 201 bp, Homo sapiens; identical to SEQ ID NO: 40920

SEQ ID NO: 65463 - DNA, 201 bp, Homo sapiens; identical to SEQ ID NO: 41628

SEQ ID NO: 65464 - DNA, 201 bp, Homo sapiens; identical to SEQ ID NO: 41629

SEQ ID NO: 65465 - DNA, 201 bp, Homo sapiens; identical to SEQ ID NO: 39230

SEQ ID NO: 65466 - DNA, 201 bp, Homo sapiens; identical to SEQ ID NO: 39234

SEQ ID NO: 65467 - DNA, 201 bp, Homo sapiens; identical to SEQ ID NO: 39236

SEQ ID NO: 65468 - DNA, 201 bp, Homo sapiens; identical to SEQ ID NO: 38345

SEQ ID NO: 65469 - DNA, 201 bp, Homo sapiens; identical to SEQ ID NO: 42966

SEQ ID NO: 65470 - DNA, 201 bp, Homo sapiens; identical to SEQ ID NO: 40406

SEQ ID NO: 65471 - DNA, 201 bp, Homo sapiens; identical to SEQ ID NO: 40411

SEQ ID NO: 65472 - DNA, 201 bp, Homo sapiens; identical to SEQ ID NO: 40416

SEQ ID NO: 65473 - DNA, 201 bp, Homo sapiens; identical to SEQ ID NO: 40420

SEQ ID NO: 65474 - DNA, 201 bp, Homo sapiens; identical to SEQ ID NO: 40934

SEQ ID NO: 65475 - DNA, 201 bp, Homo sapiens; identical to SEQ ID NO: 40424

SEQ ID NO: 65476 - DNA, 201 bp, Homo sapiens; identical to SEQ ID NO: 40935

SEQ ID NO: 65477 - DNA, 201 bp, Homo sapiens; identical to SEQ ID NO: 40427

SEQ ID NO: 65478 - DNA, 201 bp, Homo sapiens; identical to SEQ ID NO: 40430

SEQ ID NO: 65479 - DNA, 201 bp, Homo sapiens; identical to SEQ ID NO: 40432

SEQ ID NO: 65480 - DNA, 201 bp, Homo sapiens; identical to SEQ ID NO: 40435

SEQ ID NO: 65481 - DNA, 201 bp, Homo sapiens; identical to SEQ ID NO: 42340

SEQ ID NO: 65482 - DNA, 201 bp, Homo sapiens; identical to SEQ ID NO: 42342

SEQ ID NO: 65483 - DNA, 201 bp, Homo sapiens; identical to SEQ ID NO: 40484

SEQ ID NO: 65484 - DNA, 201 bp, Homo sapiens; identical to SEQ ID NO: 40494

SEQ ID NO: 65485 - DNA, 201 bp, Homo sapiens; identical to SEQ ID NO: 40499

SEQ ID NO: 65486 - DNA, 201 bp, Homo sapiens; identical to SEQ ID NO: 40944

SEQ ID NO: 65487 - DNA, 201 bp, Homo sapiens; identical to SEQ ID NO: 40945

SEQ ID NO: 65488 - DNA, 201 bp, Homo sapiens; identical to SEQ ID NO: 40946

SEQ ID NO: 65489 - DNA, 201 bp, Homo sapiens; identical to SEQ ID NO: 41655

SEQ ID NO: 65490 - DNA, 201 bp, Homo sapiens; identical to SEQ ID NO: 41204

SEQ ID NO: 65491 - DNA, 201 bp, Homo sapiens; identical to SEQ ID NO: 38915

SEQ ID NO: 65492 - DNA, 201 bp, Homo sapiens; identical to SEQ ID NO: 39249

SEQ ID NO: 65493 - DNA, 201 bp, Homo sapiens; identical to SEQ ID NO: 41660

SEQ ID NO: 65494 - DNA, 201 bp, Homo sapiens; identical to SEQ ID NO: 42974

SEQ ID NO: 65495 - DNA, 201 bp, Homo sapiens; identical to SEQ ID NO: 42151

SEQ ID NO: 65496 - DNA, 201 bp, Homo sapiens; identical to SEQ ID NO: 41668

SEQ ID NO: 65497 - DNA, 201 bp, Homo sapiens; identical to SEQ ID NO: 41669

SEQ ID NO: 65498 - DNA, 201 bp, Homo sapiens; identical to SEQ ID NO: 41670
  misc_feature (1)...(201): n = A,T,C or G, or insertion/deletion polymorphism (see Tables 1-2)

SEQ ID NO: 65499 - DNA, 201 bp, Homo sapiens; identical to SEQ ID NO: 40957

SEQ ID NO: 65500 - DNA, 201 bp, Homo sapiens; identical to SEQ ID NO: 40960

SEQ ID NO: 65501 - DNA, 201 bp, Homo sapiens; identical to SEQ ID NO: 40962

SEQ ID NO: 65502 - DNA, 201 bp, Homo sapiens; identical to SEQ ID NO: 42724

SEQ ID NO: 65503 - DNA, 201 bp, Homo sapiens; identical to SEQ ID NO: 42730

SEQ ID NO: 65504 - DNA, 201 bp, Homo sapiens; identical to SEQ ID NO: 42991

SEQ ID NO: 65505 - DNA, 201 bp, Homo sapiens; identical to SEQ ID NO: 42168

SEQ ID NO: 65506 - DNA, 201 bp, Homo sapiens; identical to SEQ ID NO: 41965

SEQ ID NO: 65507 - DNA, 201 bp, Homo sapiens; identical to SEQ ID NO: 43254

SEQ ID NO: 65508 - DNA, 201 bp, Homo sapiens; identical to SEQ ID NO: 42172

SEQ ID NO: 65509 - DNA, 201 bp, Homo sapiens; identical to SEQ ID NO: 42173

SEQ ID NO: 65510 - DNA, 201 bp, Homo sapiens; identical to SEQ ID NO: 39260

SEQ ID NO: 65511 - DNA, 201 bp, Homo sapiens; identical to SEQ ID NO: 42995

SEQ ID NO: 65512 - DNA, 201 bp, Homo sapiens; identical to SEQ ID NO: 42996

SEQ ID NO: 65513 - DNA, 201 bp, Homo sapiens; identical to SEQ ID NO: 42997

SEQ ID NO: 65514 - DNA, 201 bp, Homo sapiens; identical to SEQ ID NO: 41679

SEQ ID NO: 65515 - DNA, 201 bp, Homo sapiens; identical to SEQ ID NO: 41968

SEQ ID NO: 65516 - DNA, 201 bp, Homo sapiens; identical to SEQ ID NO: 40971

SEQ ID NO: 65517 - DNA, 201 bp, Homo sapiens; identical to SEQ ID NO: 41680

SEQ ID NO: 65518 - DNA, 201 bp, Homo sapiens; identical to SEQ ID NO: 40972

SEQ ID NO: 65519 - DNA, 201 bp, Homo sapiens; identical to SEQ ID NO: 40068

SEQ ID NO: 65520 - DNA, 201 bp, Homo sapiens; identical to SEQ ID NO: 41682

SEQ ID NO: 65521 - DNA, 201 bp, Homo sapiens; identical to SEQ ID NO: 38431

SEQ ID NO: 65522 - DNA, 201 bp, Homo sapiens; identical to SEQ ID NO: 38433

SEQ ID NO: 65523 - DNA, 201 bp, Homo sapiens; identical to SEQ ID NO: 41684

SEQ ID NO: 65524 - DNA, 201 bp, Homo sapiens; identical to SEQ ID NO: 41685

SEQ ID NO: 65525 - DNA, 201 bp, Homo sapiens; identical to SEQ ID NO: 40982

SEQ ID NO: 65526 - DNA, 201 bp, Homo sapiens; identical to SEQ ID NO: 40659

SEQ ID NO: 65527 - DNA, 201 bp, Homo sapiens; identical to SEQ ID NO: 40663

SEQ ID NO: 65528 - DNA, 201 bp, Homo sapiens; identical to SEQ ID NO: 40666

SEQ ID NO: 65529 - DNA, 201 bp, Homo sapiens; identical to SEQ ID NO: 43296

SEQ ID NO: 65530 - DNA, 201 bp, Homo sapiens; identical to SEQ ID NO: 43003

SEQ ID NO: 65531 - DNA, 201 bp, Homo sapiens; identical to SEQ ID NO: 43004

SEQ ID NO: 65532 - DNA, 201 bp, Homo sapiens; identical to SEQ ID NO: 43005

SEQ ID NO: 65533 - DNA, 201 bp, Homo sapiens; identical to SEQ ID NO: 42783

SEQ ID NO: 65534 - DNA, 201 bp, Homo sapiens; identical to SEQ ID NO: 38462

SEQ ID NO: 65535 - DNA, 201 bp, Homo sapiens; identical to SEQ ID NO: 42785

SEQ ID NO: 65536 - DNA, 201 bp, Homo sapiens; identical to SEQ ID NO: 40087

SEQ ID NO: 65537 - DNA, 201 bp, Homo sapiens; identical to SEQ ID NO: 42788

SEQ ID NO: 65538 - DNA, 201 bp, Homo sapiens; identical to SEQ ID NO: 40088

SEQ ID NO: 65539 - DNA, 201 bp, Homo sapiens; identical to SEQ ID NO: 42791

SEQ ID NO: 65540 - DNA, 201 bp, Homo sapiens; identical to SEQ ID NO: 42793

SEQ ID NO: 65541 - DNA, 201 bp, Homo sapiens; identical to SEQ ID NO: 42794

SEQ ID NO: 65542 - DNA, 201 bp, Homo sapiens; identical to SEQ ID NO: 42796

SEQ ID NO: 65543 - DNA, 201 bp, Homo sapiens; identical to SEQ ID NO: 42799

SEQ ID NO: 65544 - DNA, 201 bp, Homo sapiens; identical to SEQ ID NO: 43013

SEQ ID NO: 65545 - DNA, 201 bp, Homo sapiens; identical to SEQ ID NO: 41691

SEQ ID NO: 65546 - DNA, 201 bp, Homo sapiens; identical to SEQ ID NO: 41693

SEQ ID NO: 65547 - DNA, 201 bp, Homo sapiens; identical to SEQ ID NO: 41695

SEQ ID NO: 65548 - DNA, 201 bp, Homo sapiens; identical to SEQ ID NO: 40994

SEQ ID NO: 65549 - DNA, 201 bp, Homo sapiens; identical to SEQ ID NO: 40995

SEQ ID NO: 65550 - DNA, 201 bp, Homo sapiens; identical to SEQ ID NO: 40996

SEQ ID NO: 65551 - DNA, 201 bp, Homo sapiens; identical to SEQ ID NO: 40099

SEQ ID NO: 65552 - DNA, 201 bp, Homo sapiens; identical to SEQ ID NO: 40708

SEQ ID NO: 65553 - DNA, 201 bp, Homo sapiens; identical to SEQ ID NO: 42833

SEQ ID NO: 65554 - DNA, 201 bp, Homo sapiens; identical to SEQ ID NO: 40712

SEQ ID NO: 65555 - DNA, 201 bp, Homo sapiens; identical to SEQ ID NO: 43023

SEQ ID NO: 65556 - DNA, 201 bp, Homo sapiens; identical to SEQ ID NO: 43024

SEQ ID NO: 65557 - DNA, 201 bp, Homo sapiens; identical to SEQ ID NO: 38059

SEQ ID NO: 65558 - DNA, 201 bp, Homo sapiens; identical to SEQ ID NO: 42835

SEQ ID NO: 65559 - DNA, 201 bp, Homo sapiens; identical to SEQ ID NO: 43026

SEQ ID NO: 65560 - DNA, 201 bp, Homo sapiens; identical to SEQ ID NO: 42836

SEQ ID NO: 65561 - DNA, 201 bp, Homo sapiens; identical to SEQ ID NO: 42838

SEQ ID NO: 65562 - DNA, 201 bp, Homo sapiens; identical to SEQ ID NO: 43027

SEQ ID NO: 65563 - DNA, 201 bp, Homo sapiens; identical to SEQ ID NO: 42840

SEQ ID NO: 65564 - DNA, 201 bp, Homo sapiens; identical to SEQ ID NO: 42842

SEQ ID NO: 65565 - DNA, 201 bp, Homo sapiens; identical to SEQ ID NO: 42844

SEQ ID NO: 65566 - DNA, 201 bp, Homo sapiens; identical to SEQ ID NO: 42847

SEQ ID NO: 65567 - DNA, 201 bp, Homo sapiens; identical to SEQ ID NO: 40723

SEQ ID NO: 65568 - DNA, 201 bp, Homo sapiens; identical to SEQ ID NO: 42859

SEQ ID NO: 65569 - DNA, 201 bp, Homo sapiens; identical to SEQ ID NO: 40726

SEQ ID NO: 65570 - DNA, 201 bp, Homo sapiens; identical to SEQ ID NO: 40727

SEQ ID NO: 65571 - DNA, 201 bp, Homo sapiens; identical to SEQ ID NO: 42462

SEQ ID NO: 65572 - DNA, 201 bp, Homo sapiens; identical to SEQ ID NO: 42465

SEQ ID NO: 65573 - DNA, 201 bp, Homo sapiens; identical to SEQ ID NO: 41007

SEQ ID NO: 65574 - DNA, 201 bp, Homo sapiens; identical to SEQ ID NO: 38082

SEQ ID NO: 65575 - DNA, 201 bp, Homo sapiens; identical to SEQ ID NO: 41009

SEQ ID NO: 65576 - DNA, 201 bp, Homo sapiens; identical to SEQ ID NO: 41010

SEQ ID NO: 65577 - DNA, 201 bp, Homo sapiens; identical to SEQ ID NO: 41011

SEQ ID NO: 65578 - DNA, 201 bp, Homo sapiens; identical to SEQ ID NO: 42877

SEQ ID NO: 65579 - DNA, 201 bp, Homo sapiens; identical to SEQ ID NO: 42878

SEQ ID NO: 65580 - DNA, 201 bp, Homo sapiens; identical to SEQ ID NO: 39350

SEQ ID NO: 65581 - DNA, 201 bp, Homo sapiens; identical to SEQ ID NO: 39354

SEQ ID NO: 65582 - DNA, 201 bp, Homo sapiens; identical to SEQ ID NO: 38098

SEQ ID NO: 65583 - DNA, 201 bp, Homo sapiens; identical to SEQ ID NO: 38099

SEQ ID NO: 65584 - DNA, 201 bp, Homo sapiens; identical to SEQ ID NO: 38100

SEQ ID NO: 65585 - DNA, 201 bp, Homo sapiens; identical to SEQ ID NO: 43042

SEQ ID NO: 65586 - DNA, 201 bp, Homo sapiens; identical to SEQ ID NO: 43043

SEQ ID NO: 65587 - DNA, 201 bp, Homo sapiens; identical to SEQ ID NO: 41016

SEQ ID NO: 65588 - DNA, 201 bp, Homo sapiens; identical to SEQ ID NO: 38103

SEQ ID NO: 65589 - DNA, 201 bp, Homo sapiens; identical to SEQ ID NO: 41017

SEQ ID NO: 65590 - DNA, 201 bp, Homo sapiens; identical to SEQ ID NO: 38104

SEQ ID NO: 65591 - DNA, 201 bp, Homo sapiens; identical to SEQ ID NO: 43044

SEQ ID NO: 65592 - DNA, 201 bp, Homo sapiens; identical to SEQ ID NO: 38105

SEQ ID NO: 65593 - DNA, 201 bp, Homo sapiens; identical to SEQ ID NO: 39382

SEQ ID NO: 65594 - DNA, 201 bp, Homo sapiens; identical to SEQ ID NO: 38106

SEQ ID NO: 65595 - DNA, 201 bp, Homo sapiens; identical to SEQ ID NO: 39383

SEQ ID NO: 65596 - DNA, 201 bp, Homo sapiens; identical to SEQ ID NO: 43049

SEQ ID NO: 65597 - DNA, 201 bp, Homo sapiens; identical to SEQ ID NO: 42493

SEQ ID NO: 65598 - DNA, 201 bp, Homo sapiens; identical to SEQ ID NO: 43050

SEQ ID NO: 65599 - DNA, 201 bp, Homo sapiens; identical to SEQ ID NO: 42494

SEQ ID NO: 65600 - DNA, 201 bp, Homo sapiens; identical to SEQ ID NO: 43052

SEQ ID NO: 65601 - DNA, 201 bp, Homo sapiens; identical to SEQ ID NO: 42495

SEQ ID NO: 65602 - DNA, 201 bp, Homo sapiens; identical to SEQ ID NO: 42906

SEQ ID NO: 65603 - DNA, 201 bp, Homo sapiens; identical to SEQ ID NO: 38136

SEQ ID NO: 65604 - DNA, 201 bp, Homo sapiens; identical to SEQ ID NO: 38138

SEQ ID NO: 65605 - DNA, 201 bp, Homo sapiens; identical to SEQ ID NO: 38140

SEQ ID NO: 65606 - DNA, 201 bp, Homo sapiens; identical to SEQ ID NO: 38141

SEQ ID NO: 65607 - DNA, 201 bp, Homo sapiens; identical to SEQ ID NO: 41030

SEQ ID NO: 65608 - DNA, 201 bp, Homo sapiens; identical to SEQ ID NO: 38142

SEQ ID NO: 65609 - DNA, 201 bp, Homo sapiens; identical to SEQ ID NO: 38143

SEQ ID NO: 65610 - DNA, 201 bp, Homo sapiens; identical to SEQ ID NO: 41031

SEQ ID NO: 65611 - DNA, 201 bp, Homo sapiens; identical to SEQ ID NO: 41032

SEQ ID NO: 65612 - DNA, 201 bp, Homo sapiens; identical to SEQ ID NO: 40793

SEQ ID NO: 65613 - DNA, 201 bp, Homo sapiens; identical to SEQ ID NO: 42520

SEQ ID NO: 65614 - DNA, 201 bp, Homo sapiens; identical to SEQ ID NO: 42521

SEQ ID NO: 65615 - DNA, 201 bp, Homo sapiens; identical to SEQ ID NO: 42522

SEQ ID NO: 65616 - DNA, 201 bp, Homo sapiens; identical to SEQ ID NO: 39924

SEQ ID NO: 65617 - DNA, 201 bp, Homo sapiens; identical to SEQ ID NO: 39925

SEQ ID NO: 65618 - DNA, 201 bp, Homo sapiens; identical to SEQ ID NO: 39926

SEQ ID NO: 65619 - DNA, 201 bp, Homo sapiens; identical to SEQ ID NO: 39928

SEQ ID NO: 65620 - DNA, 201 bp, Homo sapiens; identical to SEQ ID NO: 40174

SEQ ID NO: 65621 - DNA, 201 bp, Homo sapiens; identical to SEQ ID NO: 40176

SEQ ID NO: 65622 - DNA, 201 bp, Homo sapiens; identical to SEQ ID NO: 40178

SEQ ID NO: 65623 - DNA, 201 bp, Homo sapiens; identical to SEQ ID NO: 40179

SEQ ID NO: 65624 - DNA, 201 bp, Homo sapiens; identical to SEQ ID NO: 40180

SEQ ID NO: 65625 - DNA, 201 bp, Homo sapiens; identical to SEQ ID NO: 40181

SEQ ID NO: 65626 - DNA, 201 bp, Homo sapiens; identical to SEQ ID NO: 43065

SEQ ID NO: 65627 - DNA, 201 bp, Homo sapiens; identical to SEQ ID NO: 40182

SEQ ID NO: 65628 - DNA, 201 bp, Homo sapiens; identical to SEQ ID NO: 38174

SEQ ID NO: 65629 - DNA, 201 bp, Homo sapiens; identical to SEQ ID NO: 40184

SEQ ID NO: 65630 - DNA, 201 bp, Homo sapiens; identical to SEQ ID NO: 38175

SEQ ID NO: 65631 - DNA, 201 bp, Homo sapiens; identical to SEQ ID NO: 40185

SEQ ID NO: 65632 - DNA, 201 bp, Homo sapiens; identical to SEQ ID NO: 38176

SEQ ID NO: 65633 - DNA, 201 bp, Homo sapiens; identical to SEQ ID NO: 40186

SEQ ID NO: 65634 - DNA, 201 bp, Homo sapiens; identical to SEQ ID NO: 39938

SEQ ID NO: 65635 - DNA, 201 bp, Homo sapiens; identical to SEQ ID NO: 42920

SEQ ID NO: 65636 - DNA, 201 bp, Homo sapiens; identical to SEQ ID NO: 39939

SEQ ID NO: 65637 - DNA, 201 bp, Homo sapiens; identical to SEQ ID NO: 39940

SEQ ID NO: 65638 - DNA, 201 bp, Homo sapiens; identical to SEQ ID NO: 39941

SEQ ID NO: 65639 - DNA, 201 bp, Homo sapiens; identical to SEQ ID NO: 39947

SEQ ID NO: 65640 - DNA, 201 bp, Homo sapiens; identical to SEQ ID NO: 39950

SEQ ID NO: 65641 - DNA, 201 bp, Homo sapiens; identical to SEQ ID NO: 39954

SEQ ID NO: 65642 - DNA, 201 bp, Homo sapiens; identical to SEQ ID NO: 43071

SEQ ID NO: 65643 - DNA, 201 bp, Homo sapiens; identical to SEQ ID NO: 39473

SEQ ID NO: 65644 - DNA, 201 bp, Homo sapiens; identical to SEQ ID NO: 40196

SEQ ID NO: 65645 - DNA, 201 bp, Homo sapiens; identical to SEQ ID NO: 40197

SEQ ID NO: 65646 - DNA, 201 bp, Homo sapiens; identical to SEQ ID NO: 40199

SEQ ID NO: 65647 - DNA, 201 bp, Homo sapiens; identical to SEQ ID NO: 40200

SEQ ID NO: 65648 - DNA, 201 bp, Homo sapiens; identical to SEQ ID NO: 41757

SEQ ID NO: 65649 - DNA, 201 bp, Homo sapiens; identical to SEQ ID NO: 40202

SEQ ID NO: 65650 - DNA, 201 bp, Homo sapiens; identical to SEQ ID NO: 42074

SEQ ID NO: 65651 - DNA, 201 bp, Homo sapiens; identical to SEQ ID NO: 42075

SEQ ID NO: 65652 - DNA, 201 bp, Homo sapiens; identical to SEQ ID NO: 40206

SEQ ID NO: 65653 - DNA, 201 bp, Homo sapiens; identical to SEQ ID NO: 43073

SEQ ID NO: 65654 - DNA, 201 bp, Homo sapiens; identical to SEQ ID NO: 41535

SEQ ID NO: 65655 - DNA, 201 bp, Homo sapiens; identical to SEQ ID NO: 43075

SEQ ID NO: 65656 - DNA, 201 bp, Homo sapiens; identical to SEQ ID NO: 40209

SEQ ID NO: 65657 - DNA, 201 bp, Homo sapiens; identical to SEQ ID NO: 40211

SEQ ID NO: 65658 - DNA, 201 bp, Homo sapiens; identical to SEQ ID NO: 43077

SEQ ID NO: 65659 - DNA, 201 bp, Homo sapiens; identical to SEQ ID NO: 40213

SEQ ID NO: 65660 - DNA, 201 bp, Homo sapiens; identical to SEQ ID NO: 38215

SEQ ID NO: 65661 - DNA, 201 bp, Homo sapiens; identical to SEQ ID NO: 39968

SEQ ID NO: 65662 - DNA, 201 bp, Homo sapiens; identical to SEQ ID NO: 39970

SEQ ID NO: 65663 - DNA, 201 bp, Homo sapiens; identical to SEQ ID NO: 39972

SEQ ID NO: 65664 - DNA, 201 bp, Homo sapiens; identical to SEQ ID NO: 38683

SEQ ID NO: 65665 - DNA, 201 bp, Homo sapiens; identical to SEQ ID NO: 39976

SEQ ID NO: 65666 - DNA, 201 bp, Homo sapiens; identical to SEQ ID NO: 39977

SEQ ID NO: 65667 - DNA, 201 bp, Homo sapiens; identical to SEQ ID NO: 43466

SEQ ID NO: 65668 - DNA, 201 bp, Homo sapiens; identical to SEQ ID NO: 42554

SEQ ID NO: 65669 - DNA, 201 bp, Homo sapiens; identical to SEQ ID NO: 43079

SEQ ID NO: 65670 - DNA, 201 bp, Homo sapiens; identical to SEQ ID NO: 38250

SEQ ID NO: 65671 - DNA, 201 bp, Homo sapiens; identical to SEQ ID NO: 40231

SEQ ID NO: 65672 - DNA, 201 bp, Homo sapiens; identical to SEQ ID NO: 43467

SEQ ID NO: 65673 - DNA, 201 bp, Homo sapiens; identical to SEQ ID NO: 40232

SEQ ID NO: 65674 - DNA, 201 bp, Homo sapiens; identical to SEQ ID NO: 41558

SEQ ID NO: 65675 - DNA, 201 bp, Homo sapiens; identical to SEQ ID NO: 43469

SEQ ID NO: 65676 - DNA, 201 bp, Homo sapiens; identical to SEQ ID NO: 38254

SEQ ID NO: 65677 - DNA, 201 bp, Homo sapiens; identical to SEQ ID NO: 40233

SEQ ID NO: 65678 - DNA, 201 bp, Homo sapiens; identical to SEQ ID NO: 41046

SEQ ID NO: 65679 - DNA, 201 bp, Homo sapiens; identical to SEQ ID NO: 38255

SEQ ID NO: 65680 - DNA, 201 bp, Homo sapiens; identical to SEQ ID NO: 40235

SEQ ID NO: 65681 - DNA, 201 bp, Homo sapiens; identical to SEQ ID NO: 40238

SEQ ID NO: 65682 - DNA, 201 bp, Homo sapiens; identical to SEQ ID NO: 40240

SEQ ID NO: 65683 - DNA, 201 bp, Homo sapiens; identical to SEQ ID NO: 40242

SEQ ID NO: 65684 - DNA, 201 bp, Homo sapiens; identical to SEQ ID NO: 40244

SEQ ID NO: 65685 - DNA, 201 bp, Homo sapiens; identical to SEQ ID NO: 40247

SEQ ID NO: 65686 - DNA, 201 bp, Homo sapiens; identical to SEQ ID NO: 40249

SEQ ID NO: 65687 - DNA, 201 bp, Homo sapiens; identical to SEQ ID NO: 43088

SEQ ID NO: 65688 - DNA, 201 bp, Homo sapiens; identical to SEQ ID NO: 43090

SEQ ID NO: 65689 - DNA, 201 bp, Homo sapiens; identical to SEQ ID NO: 43091

SEQ ID NO: 65690 - DNA, 201 bp, Homo sapiens; identical to SEQ ID NO: 39988

SEQ ID NO: 65691 - DNA, 201 bp, Homo sapiens; identical to SEQ ID NO: 43488

SEQ ID NO: 65692 - DNA, 201 bp, Homo sapiens; identical to SEQ ID NO: 43489

SEQ ID NO: 65693 - DNA, 201 bp, Homo sapiens; identical to SEQ ID NO: 38724

SEQ ID NO: 65694 - DNA, 201 bp, Homo sapiens; identical to SEQ ID NO: 43490

SEQ ID NO: 65695 - DNA, 201 bp, Homo sapiens; identical to SEQ ID NO: 39550

SEQ ID NO: 65696 - DNA, 201 bp, Homo sapiens; identical to SEQ ID NO: 43492

SEQ ID NO: 65697 - DNA, 201 bp, Homo sapiens; identical to SEQ ID NO: 39551

SEQ ID NO: 65698 - DNA, 201 bp, Homo sapiens; identical to SEQ ID NO: 42946

SEQ ID NO: 65699 - DNA, 201 bp, Homo sapiens; identical to SEQ ID NO: 39166

SEQ ID NO: 65700 - DNA, 201 bp, Homo sapiens; identical to SEQ ID NO: 39169

SEQ ID NO: 65701 - DNA, 201 bp, Homo sapiens; identical to SEQ ID NO: 40265

SEQ ID NO: 65702 - DNA, 201 bp, Homo sapiens; identical to SEQ ID NO: 41071

SEQ ID NO: 65703 - DNA, 201 bp, Homo sapiens; identical to SEQ ID NO: 40266

SEQ ID NO: 65704 - DNA, 201 bp, Homo sapiens; identical to SEQ ID NO: 41073

SEQ ID NO: 65705 - DNA, 201 bp, Homo sapiens; identical to SEQ ID NO: 40267

SEQ ID NO: 65706 - DNA, 201 bp, Homo sapiens; identical to SEQ ID NO: 38287

SEQ ID NO: 65707 - DNA, 201 bp, Homo sapiens; identical to SEQ ID NO: 42100

SEQ ID NO: 65708 - DNA, 201 bp, Homo sapiens; identical to SEQ ID NO: 40270

SEQ ID NO: 65709 - DNA, 201 bp, Homo sapiens; identical to SEQ ID NO: 38289

SEQ ID NO: 65710 - DNA, 201 bp, Homo sapiens; identical to SEQ ID NO: 40272

SEQ ID NO: 65711 - DNA, 201 bp, Homo sapiens; identical to SEQ ID NO: 38290

SEQ ID NO: 65712 - DNA, 201 bp, Homo sapiens; identical to SEQ ID NO: 40274

SEQ ID NO: 65713 - DNA, 201 bp, Homo sapiens; identical to SEQ ID NO: 41805

SEQ ID NO: 65714 - DNA, 201 bp, Homo sapiens; identical to SEQ ID NO: 40276

SEQ ID NO: 65715 - DNA, 201 bp, Homo sapiens; identical to SEQ ID NO: 40278

SEQ ID NO: 65716 - DNA, 201 bp, Homo sapiens; identical to SEQ ID NO: 40280

SEQ ID NO: 65717 - DNA, 201 bp, Homo sapiens; identical to SEQ ID NO: 43506

SEQ ID NO: 65718 - DNA, 201 bp, Homo sapiens; identical to SEQ ID NO: 43510

SEQ ID NO: 65719 - DNA, 201 bp, Homo sapiens; identical to SEQ ID NO: 43513

SEQ ID NO: 65720 - DNA, 201 bp, Homo sapiens; identical to SEQ ID NO: 39183

SEQ ID NO: 65721 - DNA, 201 bp, Homo sapiens; identical to SEQ ID NO: 39185

SEQ ID NO: 65722 - DNA, 201 bp, Homo sapiens; identical to SEQ ID NO: 39186

SEQ ID NO: 65723 - DNA, 201 bp, Homo sapiens; identical to SEQ ID NO: 40883

SEQ ID NO: 65724 - DNA, 201 bp, Homo sapiens; identical to SEQ ID NO: 39191

SEQ ID NO: 65725 - DNA, 201 bp, Homo sapiens; identical to SEQ ID NO: 40306

SEQ ID NO: 65726 - DNA, 201 bp, Homo sapiens; identical to SEQ ID NO: 40884

SEQ ID NO: 65727 - DNA, 201 bp, Homo sapiens; identical to SEQ ID NO: 40309

SEQ ID NO: 65728 - DNA, 201 bp, Homo sapiens; identical to SEQ ID NO: 42885

SEQ ID NO: 65729 - DNA, 201 bp, Homo sapiens; identical to SEQ ID NO: 42886

SEQ ID NO: 65730 - DNA, 201 bp, Homo sapiens; identical to SEQ ID NO: 42887

SEQ ID NO: 65731 - DNA, 201 bp, Homo sapiens
aaagtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcc

SEQ ID NO: 65732 - DNA, 201 bp, Homo sapiens
ggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggg

SEQ ID NO: 65733 - DNA, 201 bp, Homo sapiens
ggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtc

SEQ ID NO: 65734 - DNA, 201 bp, Homo sapiens
cctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaag

SEQ ID NO: 65735 - DNA, 201 bp, Homo sapiens
tccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccttccttccttcgttcttctttagag

SEQ ID NO: 65736 - DNA, 201 bp, Homo sapiens
cttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagtt

SEQ ID NO: 65737 - DNA, 201 bp, Homo sapiens
tgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcg

SEQ ID NO: 65738 - DNA, 201 bp, Homo sapiens
ggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagc

SEQ ID NO: 65739 - DNA, 201 bp, Homo sapiens
atcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggag

SEQ ID NO: 65740 - DNA, 201 bp, Homo sapiens
cagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtgg

SEQ ID NO: 65741 - DNA, 201 bp, Homo sapiens
gccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactcccca

SEQ ID NO: 65742 - DNA, 201 bp, Homo sapiens
gagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttgg

SEQ ID NO: 65743 - DNA, 201 bp, Homo sapiens
ggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatagggacttggccagcgtttctccaacctgcttactttttc

SEQ ID NO: 65744 - DNA, 201 bp, Homo sapiens
tgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccat

SEQ ID NO: 65745 - DNA, 201 bp, Homo sapiens
tgggaaggcttgacagtgccaccccgggctatttgacagtgtgcttggggggggaaatgttagcttctgagggatggccttgtgtgcttgctgggatcatrgggacttggccagcgtttctccaacctgcttactttttctctttagctccggtctgatatacaaaaacgactgcaggaagaccccaactacagtccccag

SEQ ID NO: 65746 - DNA, 201 bp, Homo sapiens
gaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttc

SEQ ID NO: 65747 - DNA, 201 bp, Homo sapiens
gttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctca

SEQ ID NO: 65748 - DNA, 201 bp, Homo sapiens
tcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtc

SEQ ID NO: 65749 - DNA, 201 bp, Homo sapiens
atcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagt

SEQ ID NO: 65750 - DNA, 201 bp, Homo sapiens
cttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctgggggg

SEQ ID NO: 65751 - DNA, 201 bp, Homo sapiens
tagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtg

SEQ ID NO: 65752 - DNA, 201 bp, Homo sapiens
caaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggt

SEQ ID NO: 65753 - DNA, 201 bp, Homo sapiens
ctcgaactcttgaccttgtgatccacccaccttggcctcccaaagtgctgggattacaggcttgagccatcgtgcccggccagcttttttcttttttttttaagttacagagtcttgctctgtcacccagactggagtgcagtggtgcaatccagtgagttaaagctcactgtaaccttgaactcctgggctcaaacagtt

SEQ ID NO: 65754 - DNA, 201 bp, Homo sapiens
tgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttct

SEQ ID NO: 65755 - DNA, 201 bp, Homo sapiens
cccagtctctgggacactggtgagcaagggtcggggagttctagtgcgtaacagtctagggagagactcctgtggtggtgcatggaagggcaggtctgaarttctcccttgctctctatccagcagggcgccggtctgggtaccaatgcctcgttggcccagatggtgagcggccttgtggggcagcttcttatgcagcca

SEQ ID NO: 65756 - DNA, 201 bp, Homo sapiens
gtgaatgtgtgtgtgtgcaggagaaactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaa

SEQ ID NO: 65757 - DNA, 201 bp, Homo sapiens
cctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcc

SEQ ID NO: 65758 - DNA, 201 bp, Homo sapiens
gaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccg

SEQ ID NO: 65759 - DNA, 201 bp, Homo sapiens
tcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgt

SEQ ID NO: 65760 - DNA, 201 bp, Homo sapiens
atggccttgtgtgcttgctgggatcatagggacttggccagcgtttctccaacctgcttactttttctctttagctccggtctgatatacaaaaacgactrcaggaagaccccaactacagtccccagcgcttccccaatgcccagcgggcctttgctgatgatccttagctctttgctctatggcccttcctcatcaggg

SEQ ID NO: 65761 - DNA, 201 bp, Homo sapiens
gtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggat

SEQ ID NO: 65762 - DNA, 201 bp, Homo sapiens
ttgacagtgtgcttggggggggaaatgttagcttctgagggatggccttgtgtgcttgctgggatcatagggacttggccagcgtttctccaacctgcttrctttttctctttagctccggtctgatatacaaaaacgactgcaggaagaccccaactacagtccccagcgcttccccaatgcccagcgggcctttgctga

SEQ ID NO: 65763 - DNA, 201 bp, Homo sapiens
agtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctga

SEQ ID NO: 65764 - DNA, 201 bp, Homo sapiens
tcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcac

SEQ ID NO: 65765 - DNA, 201 bp, Homo sapiens
gtgccaccccgggctatttgacagtgtgcttggggggggaaatgttagcttctgagggatggccttgtgtgcttgctgggatcatagggacttggccagcstttctccaacctgcttactttttctctttagctccggtctgatatacaaaaacgactgcaggaagaccccaactacagtccccagcgcttccccaatgcc

SEQ ID NO: 65766 - DNA, 201 bp, Homo sapiens
aacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaagttctcccttgctctctatccagcagggcgccggtctg

SEQ ID NO: 65767 - DNA, 201 bp, Homo sapiens
cggggagttctagtgcgtaacagtctagggagagactcctgtggtggtgcatggaagggcaggtctgaagttctcccttgctctctatccagcagggcgcyggtctgggtaccaatgcctcgttggcccagatggtgagcggccttgtggggcagcttcttatgcagccagtccttgtgggtgagttttcattcttcccca

SEQ ID NO: 65768 - DNA, 201 bp, Homo sapiens
gctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcagtg

SEQ ID NO: 65769 - DNA, 201 bp, Homo sapiens
taaacatcttataatgatgtaatttgctttgactgtaagtgtagaacaggacgctgttcctgaatcaggaaacaagggactggtgacctgaactgccaccmccctccctggtgctcagatgcaatgaaatcgtgaggcaacaaatctatggctaggtaaagggtcaactccatttcagcaaatgtttcagatgttccttcc

SEQ ID NO: 65770 - DNA, 201 bp, Homo sapiens
agaacccacatcaaaaaaccgaattcctagctcaggtgagatcaccaaagttgcctgtgaggcttcgtggaacctgcaggtagaaaggacatctttatttygagctgcagcccagttgcttctgcgtcttggagccccttgaaaggaccctctcccttcaacagtacatagggaggccatttctggggagaaatgtagact

SEQ ID NO: 65771 - DNA, 201 bp, Homo sapiens
atccttcctacacaaagcgaagctgaaaaaaagtgcaggacactccatttcctcctgggaccagacagggaagccagagccaccatggatgtcaaattccrgcaaggaaacaccagtatagcaaaatctccacatcacattttaaagctcacacaatggctcaaagagaacccacatcaaaaaaccgaattcctagctcag

SEQ ID NO: 65772 - DNA, 201 bp, Homo sapiens
aggcaacaaatctatggctaggtaaagggtcaactccatttcagcaaatgtttcagatgttccttcctgcctagtaatgttccagctttaccccagccttratcttttaaaatgtatattttccttagcgttgattttaaagtaattcgtatgtatttattacactgggtttgttgcagtaagccacctcgaatgttgctg

SEQ ID NO: 65773 - DNA, 201 bp, Homo sapiens
ctgggacagttatattcatcagaacagcacggtgtcaaggccctcacccccagaaagcttaggagacactgttttatggaggagagtgagattggaggaasccctgactccaggtctcctgatccttcctacacaaagcgaagctgaaaaaaagtgcaggacactccatttcctcctgggaccagacagggaagccagagc

SEQ ID NO: 65774 - DNA, 201 bp, Homo sapiens
gactgtaagtgtagaacaggacgctgttcctgaatcaggaaacaagggactggtgacctgaactgccaccaccctccctggtgctcagatgcaatgaaatygtgaggcaacaaatctatggctaggtaaagggtcaactccatttcagcaaatgtttcagatgttccttcctgcctagtaatgttccagctttaccccagc

SEQ ID NO: 65775 - DNA, 201 bp, Homo sapiens
cagtcggtattttgtgcacctgtgcttttatttcaggagctgggacagttatattcatcagaacagcacggtgtcaaggccctcacccccagaaagcttargagacactgttttatggaggagagtgagattggaggaagccctgactccaggtctcctgatccttcctacacaaagcgaagctgaaaaaaagtgcaggac

SEQ ID NO: 65776 - DNA, 201 bp, Homo sapiens
atttgctttgactgtaagtgtagaacaggacgctgttcctgaatcaggaaacaagggactggtgacctgaactgccaccaccctccctggtgctcagatgyaatgaaatcgtgaggcaacaaatctatggctaggtaaagggtcaactccatttcagcaaatgtttcagatgttccttcctgcctagtaatgttccagctt

SEQ ID NO: 65777 - DNA, 201 bp, Homo sapiens
ataaaccacaatgcctggcccctgtgtgtgtacatacaaagtcaaagtgctaaacctggcgcctaggaaacatccccacctaggcattgcttgcaacagtmggtattttgtgcacctgtgcttttatttcaggagctgggacagttatattcatcagaacagcacggtgtcaaggccctcacccccagaaagcttaggaga

SEQ ID NO: 65778 - DNA, 201 bp, Homo sapiens
cttataatgatgtaatttgctttgactgtaagtgtagaacaggacgctgttcctgaatcaggaaacaagggactggtgacctgaactgccaccaccctccstggtgctcagatgcaatgaaatcgtgaggcaacaaatctatggctaggtaaagggtcaactccatttcagcaaatgtttcagatgttccttcctgcctag

SEQ ID NO: 65779 - DNA, 201 bp, Homo sapiens
tcttgaacttctggcttcaaacaattctcatgcctcagcctcccaaagtgctgagattacaggcataaaccacaatgcctggcccctgtgtgtgtacatasaaagtcaaagtgctaaacctggcgcctaggaaacatccccacctaggcattgcttgcaacagtcggtattttgtgcacctgtgcttttatttcaggagct

SEQ ID NO: 65780 - DNA, 201 bp, Homo sapiens
tcttataatgatgtaatttgctttgactgtaagtgtagaacaggacgctgttcctgaatcaggaaacaagggactggtgacctgaactgccaccaccctcyctggtgctcagatgcaatgaaatcgtgaggcaacaaatctatggctaggtaaagggtcaactccatttcagcaaatgtttcagatgttccttcctgccta

SEQ ID NO: 65781 - DNA, 201 bp, Homo sapiens
tttttttttttttttgtagagactgggtcttgctttgttacccatgctggtcttgaacttctggcttcaaacaattctcatgcctcagcctcccaaagtgmtgagattacaggcataaaccacaatgcctggcccctgtgtgtgtacatacaaagtcaaagtgctaaacctggcgcctaggaaacatccccacctaggcat

SEQ ID NO: 65782 - DNA, 201 bp, Homo sapiens
ttcaacagtacatagggaggccatttctggggagaaatgtagactgtccttagactcctgaggtttttacacttgcttgctgactctgtggactttgactwcatcattaaacatcttataatgatgtaatttgctttgactgtaagtgtagaacaggacgctgttcctgaatcaggaaacaagggactggtgacctgaact

SEQ ID NO: 65783 - DNA, 201 bp, Homo sapiens
gaattcctagctcaggtgagatcaccaaagttgcctgtgaggcttcgtggaacctgcaggtagaaaggacatctttatttcgagctgcagcccagttgctyctgcgtcttggagccccttgaaaggaccctctcccttcaacagtacatagggaggccatttctggggagaaatgtagactgtccttagactcctgaggtt

SEQ ID NO: 65784 - DNA, 201 bp, Homo sapiens
gggtcaactccatttcagcaaatgtttcagatgttccttcctgcctagtaatgttccagctttaccccagccttaatcttttaaaatgtatattttccttrgcgttgattttaaagtaattcgtatgtatttattacactgggtttgttgcagtaagccacctcgaatgttgctgtagaattaaagtaagcaaataaatgt

SEQ ID NO: 65785 - DNA, 201 bp, Homo sapiens
gtcaactccatttcagcaaatgtttcagatgttccttcctgcctagtaatgttccagctttaccccagccttaatcttttaaaatgtatattttccttagygttgattttaaagtaattcgtatgtatttattacactgggtttgttgcagtaagccacctcgaatgttgctgtagaattaaagtaagcaaataaatgtgt

SEQ ID NO: 65786 - DNA, 201 bp, Homo sapiens
gggtgggccgtgcagcagggcgcagcgaggcggacatccaaacagcggaactcagacgctgactccgagcgcaccccgggccttcccatttcatacacccwcgaggatgagacccaagcacctccaaggaatagcacccgaggtcttcaggacaccgaccggtagccatggccagatgcccggccaaccccttcagcgtgg

SEQ ID NO: 65787 - DNA, 201 bp, Homo sapiens
tctttagctgttgctttttttattgattggtaaaaagtctttatgtaataactcctgtcatattttgggaaggtgtagaagttgaaattttaggaatcacrgaacacccagaaataatgttcaaagacagcaaaccttgaaaacctataatgtgtgtgtgtgttcacagctccgccgcatgcaagagatgattgcaaggat

SEQ ID NO: 65788 - DNA, 201 bp, Homo sapiens
cccagcagctttatgtacaatttaccaagtaattttaattactgctatttcttctatgtacttgatgggtggttttttttctcatgagaatgtcatgtgcrtgatgccaccttggtgcattcctcttctctttcagcacccacatgcaggatctccaggaggtgacccaggaccttcattatgaaaacttccgttctgaga

SEQ ID NO: 65789 - DNA, 201 bp, Homo sapiens
cgactaggccctgtctgcgggtaccttcggcgaggagaggcgacgaaggtctgcaccagcgaggcacggacaggcagcagggggtagggtatagggttggrggccgccgagttggcccggggatgaggagcaaacctgtggcttccgtggtctcagtggagtcccaactgtgacctggcctactggcccagacaaacctgg

SEQ ID NO: 65790 - DNA, 201 bp, Homo sapiens
tcatccagactgagaaatgtgtaaattattttttactcatcacttctgactcctctgctcacttttaaatagcttactaactgtttccgaactcttctctyctccaaagtgtaagctccatctttatgaggccagcataggacaaaagatgaggttagcatggatggatagtagaccaggaaaggggccgtaagatgagga

SEQ ID NO: 65791 - DNA, 201 bp, Homo sapiens
tcccagtcatttagtctagttttgaataaagaatagggggtctggttaatatatacatctaaacacaaaagtcagaaagaataaaagtagtgatgttacaygagccagctgtcagtgcttaacttttccctttggcctaatgcatttggaaggtcctgaaattgtattttctttttacattgcctatgtatgtgtaagtct

SEQ ID NO: 65792 - DNA, 201 bp, Homo sapiens
agctcatttgaagcaggaagcagtgacaggtgtttgcttattttctctgagcttcattttcaacctttatggaatgaaaattttacttttagatcgataamattttatttctgtatactttctagttttgcagcatttccagtttccaggagcctcatgaatggctttttggtttagttaactttgtggtcatgtaagccc

SEQ ID NO: 65793 - DNA, 201 bp, Homo sapiens
gattgtttatataggcaaaatggaggtgccaaacagaattataacattttcggaactaaggctcatttaaagatacaaatttgattggctactattgattrcacttgaagggatttgtttaacttccttttgtaaagaagtaacagtcataaggatctctcatctcccagtcatttagtctagttttgaataaagaatagg

SEQ ID NO: 65794 - DNA, 201 bp, Homo sapiens
atattggccgggcgcggtggctcacgcttgtaatcccagcactttgggaggcggaggcgggtggatcacgaggtcaggagtttgagaccagcctgaccaaygtggtgaaaccccgtctctactgaaaatacaaaaatcagctgggcgtggtggtgtgtgcctgtaatcccagctactcaggaggctgaggcaggagaatcg

SEQ ID NO: 65795 - DNA, 201 bp, Homo sapiens
gccactacactccagcccgtgcgacagagtgagacaccatctcaatataaaaagagaaatgataaatacatgtcattttaaattttaaagtagaatttttkgggggggtagcaaataactatttgttgcagtgttatgattctgatttctttcgattcttaggaaagtggagaatgaggacatgaataaagaccagatctt

SEQ ID NO: 65796 - DNA, 201 bp, Homo sapiens
tgagaccctgtctcaacaacaaaagtttcctgtgttgtaattcattaaaattctcacattctaataatttgatggatttctagatacatatgttgtacacrttgaagtctaattatgagtttggaaatgagacattaagaaagattttagaggcagcaagaaaattccaccctctggaagctgagtaggcgctggccctga

SEQ ID NO: 65797 - DNA, 201 bp, Homo sapiens
tggcgggcatctgtagtcccagccactcaggaggctgaagcaaaagaatcgcttcaacccaggaggcagaggttgtttgcagtccagcctgggtgacagagcaagactccgtctcaagaaaaaaaaaaaagaatttctgtaattacccacagaaagaacaactgttaagtatatatccttctagaacatagcttatgtttt

SEQ ID NO: 65798 - DNA, 201 bp, Homo sapiens
caaacctttttatattttatactgcactttagtgtattttctgtcactgtaggtatagaagatctgcctcccctgtggaaattggggtctgttggtgggcktgcccctgaagcctggcttgggttgaaaagtgttcccgccctaaggccttggtgccctgaacctctgatgcctaccgggttctcctgatttgagtttcct

SEQ ID NO: 65799 - DNA, 201 bp, Homo sapiens
ctgtgtcaaacacaatttaatggttgtgtaagaagttaagcgcactcagcccctccagggctgcatccttgtggctatcctgatccccattattgaggggrgtgtagaggctgaagacagggtttggggactttactttagtgtcagttgtgtgtttctcacaatgaggtagagtgagccactccttggctatctcaatcc

SEQ ID NO: 65800 - DNA, 201 bp, Homo sapiens
ctatgtctgctaaatcagatgtatttgttgtattactcagttcttctctgtccttgcacatactgtgtttactgaatctgtccggttctcagagaactctrttaaagtttctcacttgaatttttttttttaagtttgtatttttcctagtccttgctttatgtgtttatctacagtgattatttgaatatacaggcttat

SEQ ID NO: 65801 - DNA, 201 bp, Homo sapiens
actaatttggtttttactcaaccaaattaaaaatttttttaaggaaaattagcagttggtctattcagaatcaaacctttttatattttatactgcacttyagtgtattttctgtcactgtaggtatagaagatctgcctcccctgtggaaattggggtctgttggtgggcgtgcccctgaagcctggcttgggttgaaaa

SEQ ID NO: 65802 - DNA, 201 bp, Homo sapiens
tgagccgagatcgcgcctctgcactctagcctggcgacagagcaagactctgtctcaaaaaaaaaaaaaatttgatacagctatcacctaaagcttagaawttttattgtaggtttaatttgttttcgtacaatttgtcccatgtagaaagtatctgacacttttcaagaaaatgttacatacccccagctttccaattca

SEQ ID NO: 65803 - DNA, 201 bp, Homo sapiens
aagaattaagataatttgagagagaagagttttgtatgtattttttttaaataagtgacaattctaaaattaattttagacttaagcccttagatgtggcrtttatgaaggcaatacacaacaaggtgaatattgtgcctgtcattgcaaaagctgacactctcaccctgaaggaacgggagcggctgaagaaaagggtga

SEQ ID NO: 65804 - DNA, 201 bp, Homo sapiens
ggcatgtatacttaatactgaatttctttgatttaactgacttaacaactgactaaccattgatgagcactcctgatttttatctagaacattcagatttrccataatgttccttagtggtagaggtgtgtgcctagtgatgtagaaagatacactgacttggtgcaaggccatctgcttaccacatcacaccacttggag

SEQ ID NO: 65805 - DNA, 201 bp, Homo sapiens
taatcccagcaccttgggaggctgaggcgggcgggtcatgaggtcaggagatcgagaccatcctggctaacacagtgaaaccccatctctactaaaaattwaaaaaaaattagccgggcatggtggcgggcgcctgtagtcccagctactcgggaggctgaggcaggagaagggcgtgaacccaggaggtggaggttgcag

SEQ ID NO: 65806 - DNA, 201 bp, Homo sapiens
tcatactgcaaacatagtagtactgtaggtactaaacacagaatgatgtttgtgaggtacttagcccagtaccaggccttatgtaaacacttaaccgattsaatggtgtcatatgaataaggtcatgacaaggtttttctttttatttaaaggtgaatcaggtctaggaaaatcgactctcataaacagcctattcctaac

SEQ ID NO: 65807 - DNA, 201 bp, Homo sapiens
gggaggctgaggcgggcgggtcatgaggtcaggagatcgagaccatcctggctaacacagtgaaaccccatctctactaaaaattaaaaaaaaattagccrggcatggtggcgggcgcctgtagtcccagctactcgggaggctgaggcaggagaagggcgtgaacccaggaggtggaggttgcagtgagctgagatcacc

SEQ ID NO: 65808 - DNA, 201 bp, Homo sapiens
caagattgcaccactgcactccagcctgggcgacagagcgagactctgtctcaaaaaaataataaattaaataaataaatttcacatattgtaacatgcayacattgcttttactcttgaaaaaagaggctgaggccgggtgcggtggctcatgcctgtactcctggcattttgggaggcccaggcgggcggatcacttga

SEQ ID NO: 65809 - DNA, 201 bp, Homo sapiens
ctttcttttctctacacacatcagtaacagtcctttggcccccttagttcattcccagcagaccagataatttagaattctgataatttattatgatgaamttgatggggctcttagacttgataaattggtttaaatcagcctttgcaagttagttcagagataaattagtgctaaagaacatattctgagaaaagcaga

SEQ ID NO: 65810 - DNA, 201 bp, Homo sapiens
tccatttccctggatcctgaatcaataggaacgtgttacaatgtttgctcattcttgcctgcttttaagtattttgaataagctaggcaattaaaaaaaawtttttaagagtgcttcataagatgaatggaaggttaagttgctgactaatattcttggatccagaatattagtccttcactttatggtcttgtacatagc

SEQ ID NO: 65811 - DNA, 201 bp, Homo sapiens
tggtcttgaactcctgacctcaagtggtctgcctacctcggcctcccaaagtgctggaattacaggcgtgagcatcacgtctggcctaatttttttaatcraatttatttttgtaatgatagatgcttgtcttattcctagggaaatatttgaagtaattgagatgctgtcacctaaaataatcaaaaggctcctgattca

SEQ ID NO: 65812 - DNA, 201 bp, Homo sapiens
attcttgaaatcatccagactgagaaatgtgtaaattattttttactcatcacttctgactcctctgctcacttttaaatagcttactaactgtttccgarctcttctctcctccaaagtgtaagctccatctttatgaggccagcataggacaaaagatgaggttagcatggatggatagtagaccaggaaaggggccgt

SEQ ID NO: 65813 - DNA, 201 bp, Homo sapiens
tgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcg

SEQ ID NO: 65814 - DNA, 201 bp, Homo sapiens
gctacaccaaagaatggtgattagcgctcccagggtggggaaaaatgaggattgtttatataggcaaaatggaggtgccaaacagaattataacattttcrgaactaaggctcatttaaagatacaaatttgattggctactattgattacacttgaagggatttgtttaacttccttttgtaaagaagtaacagtcataa

SEQ ID NO: 65815 - DNA, 201 bp, Homo sapiens
gttttgaataaagaatagggggtctggttaatatatacatctaaacacaaaagtcagaaagaataaaagtagtgatgttacacgagccagctgtcagtgcytaacttttccctttggcctaatgcatttggaaggtcctgaaattgtattttctttttacattgcctatgtatgtgtaagtcttcttcaggtcagttcacg

SEQ ID NO: 65816 - DNA, 201 bp, Homo sapiens
cctttggtacattgtgaacagtctaatatatggattatattcacagagaagacaggaaagcaaaaaaaaaaaacatgaaaaaataatgcctgggaattgtscaattttcagcaaagttgtaaatgcacagatccaagaagcttgacaaataccaggcaaaataaatataaagaaaactacaccaggacgcatcataacacg

SEQ ID NO: 65817 - DNA, 201 bp, Homo sapiens
tgggtaagtaattgtttatcgtggagaaatgctttactacatgggtttgtaagttttacccaaactgtgtattttaatataagaattaagataatttgagrgagaagagttttgtatgtattttttttaaataagtgacaattctaaaattaattttagacttaagcccttagatgtggcgtttatgaaggcaatacacaa

SEQ ID NO: 65818 - DNA, 201 bp, Homo sapiens
attgaagataagaggagtgaccactgaattgtcattaggaataacataactggtcgggcgtgatggctcatgcctgtaatcccagcactctgggaggccaragcgggtggatcatttgaggtcaggagtttgagaccagcctggccaacatggcaaaaccccatctctactaaaaatacaaaaacctgggcgtggtggtgc

SEQ ID NO: 65819 - DNA, 201 bp, Homo sapiens
gttcacgccattctcccacctcagcctccaagtagctaagattacaggcacccgccaccacacctggctaattttgtttctgtatttttagtagagacggkgtttcaccgtgttagccatgatggtctcgatctcctgacttcgtgatccgcccgcctcggcctctcaaagcgctaggattaatataaatcttacacagac

SEQ ID NO: 65820 - DNA, 201 bp, Homo sapiens
ggtagggggatacagcagggggttcaggcaggaggatcacttgagcccagaagttggaggccaacctcagcaacatagcaatacgctgtctctaaaaaaawatatatatatattttatatatataatatataattaataaatatatataatatatattacatatatattatatctatattatttatattacatatgtaata

SEQ ID NO: 65821 - DNA, 201 bp, Homo sapiens
cctggctatggtgacgctatcaactgcagagattggtatgctcccccatgcccagggatctgcatttgtttacttaatatacttcataaatttatagatartgttaatgagtgattattaagtttgggattgctgtatataataaaacacctagacaatttaaagcgtgttaaatgttgactttttaaataaggaatttta

SEQ ID NO: 65822 - DNA, 201 bp, Homo sapiens
attatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcct

SEQ ID NO: 65823 - DNA, 201 bp, Homo sapiens
ttatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcctg

SEQ ID NO: 65824 - DNA, 201 bp, Homo sapiens
tatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcctgt

SEQ ID NO: 65825 - DNA, 201 bp, Homo sapiens
ggtaagtgcctgctcttttctatcctcagcattggcatttaatctttccatgtgaacttaaagctcattttatccaatcctttaagaaaaaagccacaccrttagggattccagttagaaatggactaaataacatactcatttggggaaaataaaaatgatttgatttatgtaggacctgttttctagtttggtccctac

SEQ ID NO: 65826 - DNA, 201 bp, Homo sapiens
cacctcactagacatttccacggccatactcattatcctgaaatcccagcagctttatgtacaatttaccaagtaattttaattactgctatttcttctaygtacttgatgggtggttttttttctcatgagaatgtcatgtgcgtgatgccaccttggtgcattcctcttctctttcagcacccacatgcaggatctcca

SEQ ID NO: 65827 - DNA, 201 bp, Homo sapiens
tcctaaattgtctcaagtgcctgccagttttttagaaagtatttgaacctttgaagaacccctggaagcgtagacgtttttatgctaataaatactttagyaattcctacttaagggaacttcaccttttgtactctgctatattaaatttctttgaggtagaaatgggggtggtgtcagggttagaatgctgtaattcta

SEQ ID NO: 65828 - DNA, 201 bp, Homo sapiens
tttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaa

SEQ ID NO: 65829 - DNA, 201 bp, Homo sapiens
taattttcagtcgcatacaactaaggagttatactagataagtttttctttttttaatgctcctagttgaatactactggttttctgatagaagtatgacyttctggaagtgtttatactttttaaaaaatttgtgaaaactgataacctatgtttgtttcatgtctaactgattatatcttaaaagcaactactaaggtg

SEQ ID NO: 65830 - DNA, 201 bp, Homo sapiens
agtttttctttttttaatgctcctagttgaatactactggttttctgatagaagtatgaccttctggaagtgtttatactttttaaaaaatttgtgaaaamtgataacctatgtttgtttcatgtctaactgattatatcttaaaagcaactactaaggtgtttattagtttgtttgttttttaatcttatttagcaacag

SEQ ID NO: 65831 - DNA, 201 bp, Homo sapiens
caagctacgcctgacagtggtagatacccctggctatggtgacgctatcaactgcagagattggtatgctcccccatgcccagggatctgcatttgtttasttaatatacttcataaatttatagatagtgttaatgagtgattattaagtttgggattgctgtatataataaaacacctagacaatttaaagcgtgttaa

SEQ ID NO: 65832 - DNA, 201 bp, Homo sapiens
acatattatatatacatttttatatattatatatatataaatataatatacatatattttttaaaataaaagagtttctaggccgagtgtggtggctcacrcctgtaatcccagcactttggaaggctgaggcaggcacatcaccagaggtcaggaggtcgagaccagcctggccaacatggcaaaactccgtctctaaaa

SEQ ID NO: 65833 - DNA, 201 bp, Homo sapiens
tacatttttatatattatatatatataaatataatatacatatattttttaaaataaaagagtttctaggccgagtgtggtggctcacgcctgtaatcccwgcactttggaaggctgaggcaggcacatcaccagaggtcaggaggtcgagaccagcctggccaacatggcaaaactccgtctctaaaaaattacaaaagt

SEQ ID NO: 65834 - DNA, 201 bp, Homo sapiens
taatgctgtgaaaactaaaaactactcaaacataaaaactataagctgtgttgttttcacattttacttttgcagatacaatccagacctcatctccccarttatcaaatggcttttctaattttttgtttaggtcttagctcaaccattaccttctcagtgaggacttttctaaacacactatcaaaaaatagttttcac

SEQ ID NO: 65835 - DNA, 201 bp, Homo sapiens
aagtctaaaaagatgagccattcaagccacagtgtcttctatctccaagctggtgagacacactgcagtcctctacagaacagaagagagacagtgcacargattgctcttgggtaagttttctttttcttatgtaatgaatgggttactcttcagcccttagaataaaaatactataataacttaaatctatatgttctg

SEQ ID NO: 65836 - DNA, 201 bp, Homo sapiens
caaacagaaggaagagcaatacctaggacccaaaggtctataaaagtatgggcaggaaataatgaaatgaaatttggcctggataatataagctaataaayggaaaaaaaaatccaaaacatggatatgcagagagtgtgcaaaaagtggcaaagaaagagggtaataaaagatggcaaactacaaagggagtttcagcag

SEQ ID NO: 65837 - DNA, 201 bp, Homo sapiens
acaatgcagccaacagagcagaatgttcaaagccctaaatgactttcagccagttctcttttgggtttcaatgatatctcaagatatgaaagaggcggtaraatccagtgtcacatgaattatatagcagccaagagataggctggcattctaaccacaaacagaaggaagagcaatacctaggacccaaaggtctataaa

SEQ ID NO: 65838 - DNA, 201 bp, Homo sapiens
agccatctgcttccaggtcacagagacaggtggtagcagagcaagaagtagaagactggcctttttacacctagcagagaaatcttctccctacatgccayagctacagaatgacgaaaacaacctcttggaaataagatcataggggtgcctaattcttggtatcactttcttctcctccaatgtaaagaaaaatagggt

SEQ ID NO: 65839 - DNA, 201 bp, Homo sapiens
ctctctcatttcactaatgagaggagatgaatgctttggtgaaggccatagcaggcagagcaggcaaggaaggggcagagagccccttagaagtgacttcrgcattgggtatagagcacaggatttcttcctgccctttgcaaatagcacactctaattagcattgcagaattgcttatcaatgcagaatttccaagtgag

SEQ ID NO: 65840 - DNA, 201 bp, Homo sapiens
gaactggatgctagtgttgaatttggattccttgttctcttgctggccccagcactgttgtttctgaagcaggacattctatgtgatagagaggcaatgcrtgagtgttttctgtcagtgtcgttcatttgcatgtggcaatgggatgtatgtatgtgtatgtgtgtgtatctacagtcaattaaacacacatttgctggg

SEQ ID NO: 65841 - DNA, 201 bp, Homo sapiens
aaactgaattgtaaagaggaaatgggaatgactaggttatttcatcattccctaagttaatggagtgtcctagggaactccagggcatcatggaacagggscaccttgtcagggaatgggaacagcctgaatttgaaggtatgggcagtgactataagtttgttcaaggagaactgaagtacctcatgaggtctgcagagt

SEQ ID NO: 65842 - DNA, 201 bp, Homo sapiens
atgcagtgcctgagaatctgggatccacaatgtgaacttctcaacaacccctgcacctgccacttccctgaatcttccactaagcaccagaagacacatgyattttaaatcaaaggaatgtgagttggaatttcagcttctgccattcactgacaacatggccttgaacccttcataaactctaatatcttccactgcaga

SEQ ID NO: 65843 - DNA, 201 bp, Homo sapiens
agtagagacgaggggacttgaaagacaaacaaaaacaaatgaacacatttgtgtgtacaaaaataaaaacaaaatcttgtgcacagccaaactctaactcmcctcaaaaccccatcctttgggcctggcttgagaaagtttactttcagacttagagaaatgagtatgtggttttagggacaaaattcaataccgccaaag

SEQ ID NO: 65844 - DNA, 201 bp, Homo sapiens
attacaaggtatagtatggtttgtattttattttatttttatttttcttgagatggattttccctctcatcaccaaggctggaatgtaatggcaccgtctyggctcactgcaaccgcttgaaccgggttcaagcgattctcctgcctcagcttcccaagtagctgggattacaggtgcctgccaccacaaccgactcaatt

SEQ ID NO: 65845 - DNA, 201 bp, Homo sapiens
ttcaaattctagacttccctgttctaccactgggctacctgtagaacttgggtaagtgacctaacctttgtgagtcttaattacagtagttacctcatacrgtggttgacaggtttaaatgtacaaaaaacagtgtagagttctctacataatgtaatcactctgacagccaagccattctctttactctactcatcatta

SEQ ID NO: 65846 - DNA, 201 bp, Homo sapiens
gacaaacaaaaacaaatgaacacatttgtgtgtacaaaaataaaaacaaaatcttgtgcacagccaaactctaactcacctcaaaaccccatcctttgggyctggcttgagaaagtttactttcagacttagagaaatgagtatgtggttttagggacaaaattcaataccgccaaagcagcaggctcagcaagctcaact

SEQ ID NO: 65847 - DNA, 201 bp, Homo sapiens
ctcagtttcatgaaccacattcctagggcttaatatcataggtggctagaggctactgaacaggacattcatatgtagaacattttcatcatcatggaagkttctactggacagatagtctggagcctggcctgtgaacactgatacaattttgctctctctgaaacataaacccctgaccgtagctccctggtgcatgtc

SEQ ID NO: 65848 - DNA, 201 bp, Homo sapiens
aagagactctcaaagtctctctctggttaaatttctatgccccaaatactattctgttagaaaaaaaaaaaaaaaaaaagtccacatgttgttcctaattsgatttgttcctcagttgccaaaacttcacaggcagacagaagtgtttctttaaaactttgtcggttgctaccagaaggaaaactgtatttctagatcaac

SEQ ID NO: 65849 - DNA, 201 bp, Homo sapiens
gcttggaattgtctctgaaatttcagcatgttcccttcgcctttcctccttccaccaccattggcaaaggctctctcatttcactaatgagaggagatgartgctttggtgaaggccatagcaggcagagcaggcaaggaaggggcagagagccccttagaagtgacttcggcattgggtatagagcacaggatttcttcc

SEQ ID NO: 65850 - DNA, 201 bp, Homo sapiens
gctgaactagaccatggtactttctgttctgtctccttagatgacttgcacacgtgctcttgaaaaattattcagaaaccaccaggagaaagcagatcctytgggtatttgggaaaactgcttggaattgtctctgaaatttcagcatgttcccttcgcctttcctccttccaccaccattggcaaaggctctctcatttc

SEQ ID NO: 65851 - DNA, 201 bp, Homo sapiens
ggctgaactagaccatggtactttctgttctgtctccttagatgacttgcacacgtgctcttgaaaaattattcagaaaccaccaggagaaagcagatccyttgggtatttgggaaaactgcttggaattgtctctgaaatttcagcatgttcccttcgcctttcctccttccaccaccattggcaaaggctctctcattt

SEQ ID NO: 65852 - DNA, 201 bp, Homo sapiens
gttctctagacattctatatgattctaattcctgtgcttctctgtataaagtggcaactgaaacttagaaagattaagtaactcactgaatgctgcataawtgttagaggtcaagggttctgactggctgattaaggcttattatacaaatattgggaatattcaatgtcaaataaaaattgctctgtgagaaatgcatgt

SEQ ID NO: 65853 - DNA, 201 bp, Homo sapiens
cttcaagtcaagagtcaagtgtcaactgaaaaatgaagactcgctattcaaagcaggatctcaccgttccacgtggcaccttccctgatcaatcaatatgwgtttgttgtatgcctacaaatgccaaacccatcccttccttgctttcctctcttacacatttttgttccttctccagattcaatttgctcagggataatg

SEQ ID NO: 65854 - DNA, 201 bp, Homo sapiens
ttgtttaggtcttagctcaaccattaccttctcagtgaggacttttctaaacacactatcaaaaaatagttttcaccttcactagagtgtctataccactrgtctattttattcccttcatagcatgatctcacttcttcaaatgtttgcttgataattgtattctctctaaaacagaatggcaactccttgagagcagaa

SEQ ID NO: 65855 - DNA, 201 bp, Homo sapiens
aaagaaaaatagggtaagattatgttctctgtaagggtaagatctagtctctaaagtgacttaatttccttagcaaaaaacctctcggaatgacagaaatkggggttagattttagttcttctaaaggctaatttcttcctgattatgttaaagaccacaataaatttgtctgctaggaatcagcagaacctgagaatgga

SEQ ID NO: 65856 - DNA, 201 bp, Homo sapiens
cctcatctccccaattatcaaatggcttttctaattttttgtttaggtcttagctcaaccattaccttctcagtgaggacttttctaaacacactatcaamaaatagttttcaccttcactagagtgtctataccactagtctattttattcccttcatagcatgatctcacttcttcaaatgtttgcttgataattgtat

SEQ ID NO: 65857 - DNA, 201 bp, Homo sapiens
ttaataacttgcccaagatcacacagtgtgttaatacctgatctgggtctccaactcaggcattcactttccaagttctgagtgcattatttgacacaaargaatttcacagaggcaaactgggggttgtttaactccaaagaggatttcagttttgctttaaaacatgaactgatttacaagggacattggcttcaattc

SEQ ID NO: 65858 - DNA, 201 bp, Homo sapiens
caaggaaataggaggacagtcattaccctatcatacaatgttccctgccctaacaattccagatctaatcttttacaaatggtattcatgaagccctaacrgtacatttaataaagatatgctcaagtggctatagccaatgacactgccttagaggtgagtagccttgtggggcatagcggagactttgaatgtctgcag

SEQ ID NO: 65859 - DNA, 201 bp, Homo sapiens
agaatcagttgaacatgggaggtggaggttgcagtgagctgagatcacgccactgcactccagcctgggtgacagagcaagactctgtctcaaaaaaaaaataaacacataaaaataattttaaaaaacatcattttccttagcttggcatacaagaccatccacaaactgtcctcttcatgcacattccacacgaacaat

SEQ ID NO: 65860 - DNA, 201 bp, Homo sapiens
aactggtcttgttttcattacatcaatttacttggtgctccttaaatactttctgctagatgctgagcaggttgtagtgaaaagagtctgaagtcaataccaaggtcaaataacttccgtgtagtagctaggtagcattgataataatacagtaaatttcactgtgagggatactaagaaaattatacacagacatacaca

SEQ ID NO: 65861 - DNA, 201 bp, Homo sapiens
caaatctgaattctgcttcctataagcactacaaagaggacataaataaaataacctaacctctctgaacttcattttcctcatctgaaaaaaaaaaaaaatggaggtaatgatatttacccagcgttgttgcagtgatttcagatgattgtgggtataatgctggccccttcatccattttatctaatggaaaactgtga

SEQ ID NO: 65862 - DNA, 201 bp, Homo sapiens
ccaggaatccctggggcgtgtagacaccacagtccttaatgctggttttttgttcaaactcctcacataccccatcaccatcatggaaatagcaccggctrggttcatctgcaaaagattgacatagaaagggagagaataaataaatatttgttctttggcctcagcaatcatcagcagctgcagagtcagaccaccaaa

SEQ ID NO: 65863 - DNA, 201 bp, Homo sapiens
gagctgcagtgagtagtgatcacaccactgcactccagcctgggtgacagagcaagaccctgtctgaaaaaaacaaaaaaacaaaacaaaacaaaacaaamgaaaaacagaaagagaaaagaaagaaagaatgagcaaaagaaacagaataaatcaattcattataagtgaccagtagcattcatggcagttcaatataga

SEQ ID NO: 65864 - DNA, 201 bp, Homo sapiens
cccaaccaggaaaacctctcaggataaccatagaactctaataggaaatgaacataaatgtgctttgtacatcctagaataatcatcgagagaaaaaaaaatactcttcttttaatgggttgatttgcttctaagtggaggaattaaatcagcttgtgaaatcagtgctcacttgaaacacattcaagcaactttccccta

SEQ ID NO: 65865 - DNA, 201 bp, Homo sapiens
aaattggatttttgtttaggaagagataatcaccagtaattcctgacagcccccccttacaagattggaataattgccccatgaagcttcttttcaaatgctaagactggaaaattctttctctccttttctcacattagtcgcaataacatttgggtgatttttaagcacagctgctacctcaactcttcctcatgggag

SEQ ID NO: 65866 - DNA, 201 bp, Homo sapiens
ggagatcttagcagcaggcaaaaattgtagggcagtattttgggtattagagagagggaatgcccactttcccggtgttccttaaatacgtaccacatattaaaagatgcaaaagacactagctcttctagcttgttctcatgtgtcagtcattggagcaggcttgagctgcctggtcctgtagctgtatttctattatga

SEQ ID NO: 65867 - DNA, 201 bp, Homo sapiens
ccacaatatattttttttcctatgagacatcatgcctcaccatctgtcttatatattgttttattttctatcctaactgaatttgaaaagaaatggaatawctggataggaaaggtagcacatattagagtaaaatttaataaagagatttgacagtcttatgaattggaacttgaagatgcatttacatcaccttaaatt

SEQ ID NO: 65868 - DNA, 201 bp, Homo sapiens
cttgggtacagaacatgaaactaaattacacagcaaaggccatgctggctgaatgctggtgaccccacttaaaacaaaacaataacaaaaaaaaaaaaaaraaagaaagaaagaaaagaaaagaaaatgaaagacaagaacaaagaagggttttaagggagccagaacaaatgacagggataaaagaaaggtttctggtcc

SEQ ID NO: 65869 - DNA, 201 bp, Homo sapiens
gagatcctgcagacttattgtgataagaatgtgcctttgatagaattctcactcctaactcttgtacagtgactaggtcagaggctgggtatttcagttcyttggtttcttccacaggctctagcacagaactaggcacataactccaataaacaccttcgcatttatcatttttattgcatcagggaaagacagaaagtg

SEQ ID NO: 65870 - DNA, 201 bp, Homo sapiens
atattgtactttacatttaaaatatataaagaaggtagaccttgtgttgtgtgtctatactgtaataaaaagttcacaaacactttcaccttcattattcraaatattcctcataaaaacttcatgtggaagatattattcttccagatgaggaaactgagattccatacatctttaataacttgcccaagatcacacagt

SEQ ID NO: 65871 - DNA, 201 bp, Homo sapiens
catgcaaatatttagatacaccctactcactaaaaatacaaaattgacattttcctccatcacttgctgcttctttcttcctggctgtagagggacatggytctggtttcaaattctagacttccctgttctaccactgggctacctgtagaacttgggtaagtgacctaacctttgtgagtcttaattacagtagttacc

SEQ ID NO: 65872 - DNA, 201 bp, Homo sapiens
gggaatcactacatgattcgctctcttccttttgcttttgaagaggaggcagtactcttgtctaggttgcctcgagcttgatttttcctaggaagagtctycaaaggatgcaatgcagtgatgtatgaaaggaacaggtggacagcagtcacttatgtttttaacagcatcctgcagaccttccaactcaaacaagaactc

SEQ ID NO: 65873 - DNA, 201 bp, Homo sapiens
cacataccccatcaccatcatggaaatagcaccggctgggttcatctgcaaaagattgacatagaaagggagagaataaataaatatttgttctttggccwcagcaatcatcagcagctgcagagtcagaccaccaaaaccattggtactgtcaagcccatcacattagtcacgatggactattactcagtcttgaaaaaa

SEQ ID NO: 65874 - DNA, 201 bp, Homo sapiens
agggcccgaggcattgtcagttctagagcagtatgttgagcactgaaacacttctaagttctggaccagaatacgaaaacaccataatcctaaaacagggstgggtaatgccttctgctctatagccccaaacctgaaactgactgagatttagacactgaagataaaaaacaaaaatctacttagctttaatccaaatgc

SEQ ID NO: 65875 - DNA, 201 bp, Homo sapiens
tgtgtgtgagagagagagagagaagagggagagtatgagcatctggggggaaagtgagaagcacatgatacaattcccatcttcttcctaagcccaacttytaagagcctcccagctcctcctctcaagctatcaacatcttcactggaagccctgacagggtgaaaattaactaccaatctcttctaatcactgtacaag

SEQ ID NO: 65876 - DNA, 201 bp, Homo sapiens
tttgatttttccattcctgagttacttcacttagaataatggtctctaactccatcctggttgctatgaatgtcattatttcagtggtattccagggtgcwtatatatatatataatatataatatataatatatatatggtacattttctttatccacttattgattgacgggcatttgggctggttccatatttttgca

SEQ ID NO: 65877 - DNA, 201 bp, Homo sapiens
gatttattttgaacagctgtgtttgtagggtttgcagatcactgcagctgtaccagctgagtaacaggaaggttaaatttataaaagttaacttggaaatrtgctggctctttccaaggagttaatgatattgtaccctttttctccctgtcttcctctaaaacctgctgttgtgaaggtacatttaggtcattaaacatt

SEQ ID NO: 65878 - DNA, 201 bp, Homo sapiens
ataaagtgcacagcggtttatgtgacaaaagttcaaagagcttaactttgaagttagacatcacttccttaaggcttctcgtctctctatgttgctcagaygttcttctcttcacatcactctgctagattccatatttacatttcatttatgctctcatgttaaggagtttagttcttttgttttctacacttttgctaa

SEQ ID NO: 65879 - DNA, 201 bp, Homo sapiens
atggtacattttctttatccacttattgattgacgggcatttgggctggttccatatttttgcagttatgaattgtgctgctataaacatgcgtgtgcatmtgtctttttcatataatgacttctttttgtctggggagataccccatagtgggattgctggatcaaatggtatatctagttttagttctttaagaagttt

SEQ ID NO: 65880 - DNA, 201 bp, Homo sapiens
gtcctggactttttttgttggcattttttttttattacttaatctcactacttgttattggtctgttcagagtttctatttcttcccgatttaatcaaggkgcattgtgtatttccagaaatgcatccaaatcctctggattgtccagtttgtatgcataaaggtgttcatagttgccttgaatgatctttcatatttctg

SEQ ID NO: 65881 - DNA, 201 bp, Homo sapiens
acctttattaaatgatgcctttaaatatttgttatactttggttttctttcttaagtactgatatggtttggctgtattcccattcaaatctcaatttgarttgtatctcccagaattcccatgtgctgtgggagggacctagggggaggtaattgaatcatgcgggccagtctttctcgtgctattctcgtgatagtgaa

SEQ ID NO: 65882 - DNA, 201 bp, Homo sapiens
accagataatttaatgaggtaataaaaatgtttagtgtgggaaactcagtattatggttgtcaagtggggataaattttgggcagcatagtcttttaaaastcttggatcacatcattcaagtggatagtggctactcaatgtctacatcaattttagatccacagctaaattctatatcctttttgctagggctattact

SEQ ID NO: 65883 - DNA, 201 bp, Homo sapiens
attgtccagtttgtatgcataaaggtgttcatagttgccttgaatgatctttcatatttctgtggtatcagttgtaatatctcccatttcatttctaattkagcttatatggatcttctctcttctattcttggttaattgcactaatggtctaccaattttgtttatcttttcaaagaaccagctttatgttgcatttat

SEQ ID NO: 65884 - DNA, 201 bp, Homo sapiens
aggttttgttccttttataaaaattctatttttgtctgactgagttgatttgaagaaccagtctttgagtgctgaggtttttcctcagcttggtctattcrgctgttaaaacttctaattgtattataaaatccttgtagtaaatttttaagttctagaagttcatttgggttcttaaaatagctatttaatatttcagct

SEQ ID NO: 65885 - DNA, 201 bp, Homo sapiens
ggaaggtaaaaaggagaatgtttttattttaatcaaaatctaaaagaaaaaagaacataaaaatcttggttgactctgtgtcattaaaacttgctggtgasctaggtgagtgataccctagttggaattgactgaatgcttagtgaataaaatattagaagaccgcatagcttgagtggctttgagaattgttaggttttc

SEQ ID NO: 65886 - DNA, 201 bp, Homo sapiens
gaagtaattacaacagaaaaaccttcactgttacataaggtacagatataaaatgcagaaaaagcatcaagaattctgccttttattttattttatatttraacttcaggaagttttctcttcatgggataatttagtactgcttttatctatcatctgtcaatttctctgtattcttaataaaataaatattgaactaaa

SEQ ID NO: 65887 - DNA, 201 bp, Homo sapiens
ttatttcccaagtaatcagataagttagaaacctttttttaatgtaatttcgttttctagcctcttttatcatgaacttttcttttgcatttggatcatargttattgttcccaagtttgaaaatcggcctttttttaaaagtgttatgtcattgtaatcatttcatatttgaattttttagagttctggtatttcttttc

SEQ ID NO: 65888 - DNA, 201 bp, Homo sapiens
agtcctagatttggtctctttatataatctcatagttttcagaggttttgttccttttataaaaattctatttttgtctgactgagttgatttgaagaacyagtctttgagtgctgaggtttttcctcagcttggtctattcagctgttaaaacttctaattgtattataaaatccttgtagtaaatttttaagttctaga

SEQ ID NO: 65889 - DNA, 201 bp, Homo sapiens
gctatccctccccttccccccaaccacccaatagaccctggtgtgtgatgttctccaccctgtgtccatgtgttctcattgttcaactccgacttatgagkgagaacatgtggtgtttggttttctgttcctgtgttagtttgctgagaatgatggcctccagcttcatccatgtccctgcaaaggacatgaactcattct

SEQ ID NO: 65890 - DNA, 201 bp, Homo sapiens
caagtggctgtagaatgaatgaatgaatgtatgcatgatggccagtattgaatatacatttgataaacttcaacccatttgattatgaaaagcagcatttmaatttaacatattgttaatacatttacatttatacaatggtaatcaatacctaaacagaaaaagaaatgctttaagcttccttaaaatctacatattgct

SEQ ID NO: 65891 - DNA, 201 bp, Homo sapiens
tcctttgaataaaaagcactatggatttattttgaacagctgtgtttgtagggtttgcagatcactgcagctgtaccagctgagtaacaggaaggttaaawttataaaagttaacttggaaatgtgctggctctttccaaggagttaatgatattgtaccctttttctccctgtcttcctctaaaacctgctgttgtgaag

SEQ ID NO: 65892 - DNA, 201 bp, Homo sapiens
agaaaaatacaaaataaaaaaaaatgaatgggaagccttgagttcctcttggttcctttgaataaaaagcactatggatttattttgaacagctgtgtttrtagggtttgcagatcactgcagctgtaccagctgagtaacaggaaggttaaatttataaaagttaacttggaaatgtgctggctctttccaaggagttaa

SEQ ID NO: 65893 - DNA, 201 bp, Homo sapiens
gacacctactaaagaaagctgacacctttctgagaaactagccatcatagaaaggaaaaagaataagtgataactgaaaagaaactatagttgatagacawgtttaaaaattaggttcaatatttttgttctgattttatatttgatacatgcgtattatagaaaattgactagtaagaagtaaacagaactctaaggaat

SEQ ID NO: 65894 - DNA, 201 bp, Homo sapiens
atagggatctgggatgtcaggttttaattcttggtaatgtccttaggtgggagggagaaaaactgaaaatgttaatttggaaagttgtagttaaatgttgaaaaaaaacacataagattgaaaagtttggagagttgacaatttgtgcaaggtagcagaccagtccaatttgcaagtagatcccgaaagtggtgtttccaa

SEQ ID NO: 65895 - DNA, 201 bp, Homo sapiens
cataattttttttttttacccgtggtattccaccatctccagccacaaaccacaggaaatttgacaaatcagcctgtttgttataaaaagaacacatcacttttttttttttttttgccatcatcctgtgatagtgtacttcatggaaagtgtatcaatcagaggggaaccagggaagtaaaatcagcaggacttcatatt

SEQ ID NO: 65896 - DNA, 201 bp, Homo sapiens
aaaactggagcttttccaaaactgcagaatattcattttcaagggaaaatagcagaaaaatacaaaataaaaaaaaatgaatgggaagccttgagttcctyttggttcctttgaataaaaagcactatggatttattttgaacagctgtgtttgtagggtttgcagatcactgcagctgtaccagctgagtaacaggaagg

SEQ ID NO: 65897 - DNA, 201 bp, Homo sapiens
tgcaagctctgcctcccgggttcacgccattctcctgcctcagcctcccgagtagctgggaccacaggcgcccaccaccaggcccgactaattttttgtattttttttttttttttagtagagacggggtttcaccatgttagccaggatggtctggatctcctgacctcatgatccgcccgcctcggcctcccaaagtgt

SEQ ID NO: 65898 - DNA, 201 bp, Homo sapiens
agagacagggtctcactgtgttcctgggttggtttcaaactcctaggttcaaatgatcctactgcctcagcctcctcctgagtagctgggattacaaacaygtgccactgtgcctggccatttgtttcttgatggcagcctactatacatgctgttctgcatttgcatttttctgtcttggatattgactcatataaatgg

SEQ ID NO: 65899 - DNA, 201 bp, Homo sapiens
tttttggtggtggctcatgtattgattagttttgctgctctttcttcaatttgattggttttagtttttgcttatataagtttgtgttcatgctgtgttcrttttaaaactttcctcttttaattaattagctttaatgaggtgattttttttttttttttgcttgaaatatgtggtaaatccttgagtaagaggctggga

SEQ ID NO: 65900 - DNA, 201 bp, Homo sapiens
tcaatttgattggttttagtttttgcttatataagtttgtgttcatgctgtgttcgttttaaaactttcctcttttaattaattagctttaatgaggtgattttttttttttttttgcttgaaatatgtggtaaatccttgagtaagaggctgggatgtgagatcagggtatccttcaagttttacaacccatggggacag

SEQ ID NO: 65901 - DNA, 201 bp, Homo sapiens
caatttgattggttttagtttttgcttatataagtttgtgttcatgctgtgttcgttttaaaactttcctcttttaattaattagctttaatgaggtgattttttttttttttttgcttgaaatatgtggtaaatccttgagtaagaggctgggatgtgagatcagggtatccttcaagttttacaacccatggggacaga

SEQ ID NO: 65902 - DNA, 201 bp, Homo sapiens
cttctgtcttttcttctttattaattcagctagcaatctatctattttcttaatttttttcaaaaagccagtttagggatttgttgatattttgaagggtktgtgtgtgtgtgtgtgtgtgtgtgtgtgtgtgtgtgtgtgtctgcatctccttcagttctgctctgaccttggttatttcttgtcttctgctagcttagg

SEQ ID NO: 65903 - DNA, 201 bp, Homo sapiens
ccctaaaacttaaagtataataataataaaaaaagaaaagaaaagaaaagaaaagaaaaaaaaagtaaaggttaaaaacggaaaaaaaaaatatctcattkgtcaatttttagtttcattgcaattacttttgatgttttcatcttgaaatctttgcctgtacctatatcctgaatcacattgcctagattttcttctagg

SEQ ID NO: 65904 - DNA, 201 bp, Homo sapiens
atattgacaaattattggtttctgagtcaagccatcaaatattttatcaagtacctgctatgtataagccactactctaagcatttttcacttcctttttkatgcctaggagggtacttgagtaattgtcacagtcattatacctcccttccacagccagagccaagagaagtgagattagttagagcctttcctcctcat

SEQ ID NO: 65905 - DNA, 201 bp, Homo sapiens
tttgacaagcagatactgaaataatgtttgttcatttttgtatttagcttttcctaggatagatattacatatagtagcatttgtgctggatgctaaagaygcagagataatatgtagatacctagccttcagagatcttgacattgaagtggggaaatagataagtagacaaataattatattctacaacgagggctatg

SEQ ID NO: 65906 - DNA, 201 bp, Homo sapiens
gaattcaagttacgctaaaattttcttatagattcatatgagaaagcctcagaaatactgaacttctttgcattttggatgccataaccataaagatacaygcctaacactgaataaataagctttgacacaaaggattgatgcttacttctcattatataatttattaataaggcaaggataatgtatgtgtttctgtaa

SEQ ID NO: 65907 - DNA, 201 bp, Homo sapiens
ttctatgcctgtgggcctgtgatgggaggggctgtctagaaggccttcaaggccttttttctgttgtcttggatattagctcttggctctcttttagttayacagatctctttagcaagtggttgctccacagcctgcttgaatttctctcttgataatgctttttttaaatttgtttgtttgccacatgactgggctgca

SEQ ID NO: 65908 - DNA, 201 bp, Homo sapiens
tcactaggttgcctggggtgaggctacaccttatctgcaatgagattgtaaatgtaatttaaatactagaggactattccttcatttaacattattgttaycctgagttagtttgggattttttcttttttatcactgattacctgctcaattttctaataatatttgaacgttgtatatgtgaccacctgtatgtggtaa

SEQ ID NO: 65909 - DNA, 201 bp, Homo sapiens
accatatttgggaattgcagacagagggctggtatggagggaagatgtcaaatttggatttttgacatgttgagatcttttgcagatggaagcattatacrgaactgtcaactggcaaatggaaactatttctagcaaagattatgaatgaagagaatttaagagccatttgtatagcagtgacattggaactcatggtga

SEQ ID NO: 65910 - DNA, 201 bp, Homo sapiens
tcttcttgtgtgtcccaccccaggactttaattagtaatccagcacatggtaaacacacgtaaatgtttgaagaaaataaatttcataaaaataaaacagrtgttttcgtttttttcaggcaaagcactggcatattgaaaactgccttttccttcctaaaagagatactaatttagtggaaagtgagattcaaaaggaaa

SEQ ID NO: 65911 - DNA, 201 bp, Homo sapiens
tccacgtgttgcacatgacttcacaggatctacaacagagccaatcaaggaaatcatgaaagagactgtgaacatggcaaaaaaggtgggaatggggaagrggtgaagggtttcaagatatgaattttggggaaattcaagatgtgataaacactaaatcagaggaatgaacagaagatgacttgatgaagatgagtgctt

SEQ ID NO: 65912 - DNA, 201 bp, Homo sapiens
tccctctgtttttgaaacatgtttataatggtaatttttaaagtcttggttgactaactccaaaatctggataatccctgggtctgcttctaatatatatwtttttcctcttggtttttagtctcatttttcctgcttctctgcaagtcctataattttttattgtatgacagaaaatttaaaagatctatagacactgaa

SEQ ID NO: 65913 - DNA, 201 bp, Homo sapiens
gtggaagaatggttaactataaagggctgagggatgcagggaagggaggcagaaggaagagggtgagtcaagatccccaggactctccacgattttgagaygatggatgtgttttctggcttggtgctctgaagatactaataacaatttttggaaacataacttgtagctgttaaggttgaagtctatgacagtgaattt

SEQ ID NO: 65914 - DNA, 201 bp, Homo sapiens
ccacatcactatcaggactttggctactaccatttaaccagtctctaagaatttccaaaattcccctcatcttcctgtcttctgagtcctccaaactcttycaacgtctgcccattagccagttccaaagccacttgcacgttttcaggtatctttatagcaatgccccactcttgttaccaattttctgtgtcaggccat

SEQ ID NO: 65915 - DNA, 201 bp, Homo sapiens
agaatttcttaaaatatgggcctgcttgtgaataattttcccagcttttacatgtctgaaaaatgcatttatttcattttgactctgaaaggatttttcaytggatttgaagctctagatgtcagggttgttttgttgcttttttttttttttcaaatttttaaagttaacttatttccctgcatccatagttcctgttta

SEQ ID NO: 65916 - DNA, 201 bp, Homo sapiens
gcagggaagggaggcagaaggaagagggtgagtcaagatccccaggactctccacgattttgagacgatggatgtgttttctggcttggtgctctgaagakactaataacaatttttggaaacataacttgtagctgttaaggttgaagtctatgacagtgaattttaaatagatttgagatcattttctattttctcaca

SEQ ID NO: 65917 - DNA, 201 bp, Homo sapiens
cttagctcacacctgaccaatcagagagctcactaaaatgctaattaggcaaaaacaggaggtaaagaaatagccaatcatctattgcctgagagcacagygggagggacaagcatcgggatataaacccaggcattcgagccggcaacggcaaccacctttgggtcccctccctttgtatgggagctctgctttcactct

SEQ ID NO: 65918 - DNA, 201 bp, Homo sapiens
tagtcactgttgttaatgtatttttataatattatttaacagattagtgtgaatacaaatgtctactctgtgtgtcaggaatgttcctattccttaataamcatgaatgtaatgttctgtgaaccccatttaacaaaggagaaaagtgaggtacaggacattaagtcacctgtccaaggctccacagaatactagcggaaa

SEQ ID NO: 65919 - DNA, 201 bp, Homo sapiens
aactttgtattgtttctcattcttggaatattctccaagtacttttctaagtgaactgttagttgtctggaatgctgtgcaggaatagaggaagaccttaygatgtggctgtctatgtcaaggattcaaacctgtaagtttggggacattattagctgattacaaactcaattttgtcgttggtaaaataatgttggtaac

SEQ ID NO: 65920 - DNA, 201 bp, Homo sapiens
aagaagcagggctcccctggagcagagttactgcgcagaccacagcccttcttggaggacagggcggcccaggcagtgaagccagtgagctcagtgtgggrcagcctgtgggtatcatgaagggagcaagcaacatcagaggttagcctgctgcagtgatcccgtcaggcctgatggtaacagcacagcaggagccaagca

SEQ ID NO: 65921 - DNA, 201 bp, Homo sapiens
gacagaagatacaacgtgagcacctgcaaagaagcttgagcactcacggtgcatttttggagagagggtttattttggtgtggcaagtttgggaatacttygcagacatcgtgggagttaaagcagtaaagggatcttaggagcatattgacggccatttgttgaatgtatcactgtctggtcttggaaacataaagcata

SEQ ID NO: 65922 - DNA, 201 bp, Homo sapiens
gttttctccttctcctaccccccttctaccacacaattttattccataacatgattttctttatgcttacttttattttgttaaatttgcttatactgctmttagttgatttgtcagttttcagtgttattctttgtctctgatttatcataaacaaggtttctttctcctttatgctcacaatttttgtcaattgtatca

SEQ ID NO: 65923 - DNA, 201 bp, Homo sapiens
aggagctcttgcaaggcaggcctagtggtgatgaattcccgcagcattttcttgtctgaaaacaatcttgtttctcctttgcttattaagcttagtttggyttgatatggaattctggattggaaattcttttctttaagaatgttgaatattggccccctccccccaatctcttctggtttgtagagtttctgctgagag

SEQ ID NO: 65924 - DNA, 201 bp, Homo sapiens
gacttattttatggcatagacctttctacactatgggcactgaaactaaagcaaatattggaagagggattggtactgtttggaaacatttttagagaaargaaagagcaaaaagtccgacagaaattacaatatatttctgtgaagttacaccaagtgtgcccacctctcctgacctcctgcctccctttccacctcctc

SEQ ID NO: 65925 - DNA, 201 bp, Homo sapiens
taaacttttccacccttaaccttatttacaatttatagttaccttatcttaatttagattattgcagtccaaacagctctatgtatacatatgcatatccaaaatttataataaacatgtggccttccattatttaaaaaatgagggatgaggtataattttctcttgatagcatatcttttgtcctcttttctgcacata

SEQ ID NO: 65926 - DNA, 201 bp, Homo sapiens
tcttttttgaacagaaccagatttacacaatgaaaattttctcctttcctgcctctttgctgggcaccaagtgacatccattctgttaatacagttgtgatttttttttttttggctagcttaaagctgtaattggttatatgtcagttctgaggctgtgtgctgtagtcacttgatggaaacataagaagttactagttt

SEQ ID NO: 65927 - DNA, 201 bp, Homo sapiens
cacacatacatgtacgaacagatacacatttatttaatgtgattagtttggaagaaataacgtgtttacatgttgaaaaattcaaaacaacaaaaagatakgtggcatatattttctcttatcttcatgccactgcctactcagtttcctgtcctgtagacaacgagttttacgacttccacaatgtttaagggctattct

SEQ ID NO: 65928 - DNA, 201 bp, Homo sapiens
atttaagtttttcttttaatagatgctggatgtcaaatctttgtcagatgaatagtttgtgaatattttctcccgttctgtacgttgtctgtttactctgytgatggtttgttttgctgtgatgaagcttttttatttaattaggttccatttatcaacttttgttcttgttaccgttgcttttgggggcttagccaaaaa

SEQ ID NO: 65929 - DNA, 201 bp, Homo sapiens
ccgttgctttgttgcctgtttgttactggatggtggctgaaataaaaggacatttgacaatactcacctagagcttagatttagaaatcagaagcttgacmtcaagatgtgggcagtggatagcagcatgggcatcaccagggagctccttagaaatgcagcatctcaggacccaccccagatctgttgcatgggaatttg

SEQ ID NO: 65930 - DNA, 201 bp, Homo sapiens
gaaggacatatcaaggttgaggaaggagcagaagtcaaaatgaacccaagttggctacaatgaatgacttcagatattgagacattaactgagttttacatttaccgtcgttagtagaggtaaagtcaaatgtgtttggaatgtgttaagtttggggtactgatgcaccatttacaaataaagttctggaggactgaagca

SEQ ID NO: 65931 - DNA, 201 bp, Homo sapiens
aaaattcacaaatacaacacacacagaccaaaattttgggtctataaaacagaagtcattaatatgtgaacaacatatttaaaaggttcaacaggtcccargcaaccattatttgagagtcatatgaaaactattaaagtattttgattaatcatcaccactctttctcaccaacccgttgctttgttgcctgtttgttac

SEQ ID NO: 65932 - DNA, 201 bp, Homo sapiens
aaggacatatcaaggttgaggaaggagcagaagtcaaaatgaacccaagttggctacaatgaatgacttcagatattgagacattaactgagttttacatttaccgtcgttagtagaggtaaagtcaaatgtgtttggaatgtgttaagtttggggtactgatgcaccatttacaaataaagttctggaggactgaagcag

SEQ ID NO: 65933 - DNA, 201 bp, Homo sapiens
actcaggggcattttaaaaagtagaaatccttcctattgctctacatttttatttacataacactaaattatctcaaaattcacaaatacaacacacacasaccaaaattttgggtctataaaacagaagtcattaatatgtgaacaacatatttaaaaggttcaacaggtcccaggcaaccattatttgagagtcatatg

SEQ ID NO: 65934 - DNA, 201 bp, Homo sapiens
aggacatatcaaggttgaggaaggagcagaagtcaaaatgaacccaagttggctacaatgaatgacttcagatattgagacattaactgagttttacatttaccgtcgttagtagaggtaaagtcaaatgtgtttggaatgtgttaagtttggggtactgatgcaccatttacaaataaagttctggaggactgaagcaga

SEQ ID NO: 65935 - DNA, 201 bp, Homo sapiens
acatatcaaggttgaggaaggagcagaagtcaaaatgaacccaagttggctacaatgaatgacttcagatattgagacattaactgagttttacatttaccgtcgttagtagaggtaaagtcaaatgtgtttggaatgtgttaagtttggggtactgatgcaccatttacaaataaagttctggaggactgaagcagattg

SEQ ID NO: 65936 - DNA, 201 bp, Homo sapiens
ttggactagaaatgcacaggctggatatgtttattgaaatataaatggttgattctgagactatatttaatttctttaaaatgttattttctcttaggtartcagctctgatacagggtctactgtttccttctggatgatagacactgggcagaaaatcaaacagtttactggttgccacggcaacgcagaaatcagcac

SEQ ID NO: 65937 - DNA, 201 bp, Homo sapiens
catatcaaggttgaggaaggagcagaagtcaaaatgaacccaagttggctacaatgaatgacttcagatattgagacattaactgagttttacatttaccktcgttagtagaggtaaagtcaaatgtgtttggaatgtgttaagtttggggtactgatgcaccatttacaaataaagttctggaggactgaagcagattgt

SEQ ID NO: 65938 - DNA, 201 bp, Homo sapiens
atatcaaggttgaggaaggagcagaagtcaaaatgaacccaagttggctacaatgaatgacttcagatattgagacattaactgagttttacatttaccgycgttagtagaggtaaagtcaaatgtgtttggaatgtgttaagtttggggtactgatgcaccatttacaaataaagttctggaggactgaagcagattgta

SEQ ID NO: 65939 - DNA, 201 bp, Homo sapiens
gtatcatttatacattgtcaggcacatggactttaccttctatttttgtcagccttaactccacattgtttccattttacttctgcacttaaatacattcrgtgatcaccagcaagttatttttttcaaaattttctctgtcatttctcagtttagctttttttttttttttgagacagagtctcgttctgtcgcccaggc

SEQ ID NO: 65940 - DNA, 201 bp, Homo sapiens
gctagacaggtaggtgggggccagaccacagaccatctagtaaactatgctaaggactcggcatttatttaatcagaaatagggagctattgaaatattttaatcaatcattctgaattatataattttatatcctatattacctcttcaatgttcatatttatttgtattattcttaaagtgattgttctagaagttaca

SEQ ID NO: 65941 - DNA, 201 bp, Homo sapiens
gctggagtgcaatggcacgatctcaactcactgcaagctctgcctcccgggttcacgccattctcctgcctcagcctcccgagtagctgggaccacaggcrcccaccaccaggcccgactaattttttgtattttttttttttttttagtagagacggggtttcaccatgttagccaggatggtctggatctcctgacctc

SEQ ID NO: 65942 - DNA, 201 bp, Homo sapiens
ctagacaggtaggtgggggccagaccacagaccatctagtaaactatgctaaggactcggcatttatttaatcagaaatagggagctattgaaatattttaatcaatcattctgaattatataattttatatcctatattacctcttcaatgttcatatttatttgtattattcttaaagtgattgttctagaagttacaa

SEQ ID NO: 65943 - DNA, 201 bp, Homo sapiens
atgaatgacttcagatattgagacattaactgagttttacatttaccgtcgttagtagaggtaaagtcaaatgtgtttggaatgtgttaagtttggggtaytgatgcaccatttacaaataaagttctggaggactgaagcagattgtatatacactctgtgatatcatagagtctttgacaagcagatactgaaataatg

SEQ ID NO: 65944 - DNA, 201 bp, Homo sapiens
tagacaggtaggtgggggccagaccacagaccatctagtaaactatgctaaggactcggcatttatttaatcagaaatagggagctattgaaatattttaatcaatcattctgaattatataattttatatcctatattacctcttcaatgttcatatttatttgtattattcttaaagtgattgttctagaagttacaat

SEQ ID NO: 65945 - DNA, 201 bp, Homo sapiens
aattactacatgaagcaaagagaaatatcttttactttgttcaagactttgcctttaagagcatgattaaaatagattcctatcatctcattgtgtgcatrataaatacaataacgcagctctggtttacttgatgacattatttaaaaagtacctgccaattcaaaattttagatgtgttgttaaactaaacactgaaaa

SEQ ID NO: 65946 - DNA, 201 bp, Homo sapiens
gcagaaaaagcatcaagaattctgccttttattttattttatatttaaacttcaggaagttttctcttcatgggataatttagtactgcttttatctatcrtctgtcaatttctctgtattcttaataaaataaatattgaactaaagtgggagcaacatcttggtatttattctcaaggatttttatataaaaactttat

SEQ ID NO: 65947 - DNA, 201 bp, Homo sapiens
ggaggcagagaattgcttgaacctgggagccagaggttacagtgagctaagatagcaccaccgcactccaacctgggcgacagagcaagactcttgtctcaaaaaaaaaaaaaaattaactgtagtacatactgcactgctgcaatgatttcatagccaccccctgttgctgttgtggtgagctcaagtgttgcatttgtt

SEQ ID NO: 65948 - DNA, 201 bp, Homo sapiens
cccgagtagctgagattacaggcgcctgccaccatgcctggcttatttttttgtatttttggtagagacggggtttcactaaattggccaggctagtctcraactcctgacctcaggcaattcacctgcctcggcctcccaaattgctgggattataggcgtgagccaccgtgcccggcctttttttccatgctttattca

SEQ ID NO: 65949 - DNA, 201 bp, Homo sapiens
aatttgaaagagcaaattaccaattaattgaagaagagaaaaaatccactaagcaaggtttataactaaagaatggctgccctaaaatatttgaataattwgtacttgtactctgagatatcatcattctcttcacctccctattcactgaaatgtaacttctagagattttctacaaaatggaaataaaggaagtaacct

SEQ ID NO: 65950 - DNA, 201 bp, Homo sapiens
tagacatgtgacgccaagacttattcctgggctttattgctgatgaaaacaacttgccaaaaatagttccattgtcgtgtagtgaatccattttcttcatstgccaagtaatgttaaatgcactcctctttcactaaactttgaacgccctttcccctatattgttattcttgtattccaatattgtcatagtgagagtag

SEQ ID NO: 65951 - DNA, 201 bp, Homo sapiens
aatttttagaaaacaatatttaataactgaattggcttttgaaaacatttaaggaggtaacacgcaaataaagtagttgagggaataaataagtgtggcawttctttaacaaaagctttgttttgtttttagtaaatatacatctggctattcagaattttaaaatgggaatggtaaaaaaatttttgtagttcattatta

SEQ ID NO: 65952 - DNA, 201 bp, Homo sapiens
aagggatgtgaaggacctcttcaaggagaactacaaaccactgctcaacaaaataaaagaggacacaaacaaatggaagaacattccatgctcatggatargaagaatcaatattgtgaaaatggccatactgcccaaggtaatttacagattcaatgccctccccagcaagctaccaatgactttcttcacagaattgga

SEQ ID NO: 65953 - DNA, 201 bp, Homo sapiens
aaatatagagtgcccactatgtgccatattctgtggaagatatgttgctaataacttcttctgattgctgttgctcatattttctatcttaatctcctggmaatttatattctccatcctgtcttgtgtagggagttatgatggagaaattgttctatggaacaatagcacagagaatgctcaccatgttcttcaccctga

SEQ ID NO: 65954 - DNA, 201 bp, Homo sapiens
catgctcatggataggaagaatcaatattgtgaaaatggccatactgcccaaggtaatttacagattcaatgccctccccagcaagctaccaatgactttyttcacagaattggaaaaaactactttaaagttcatatggaaccaaaaaagagcctgcattgccaagacaatcctaagccaaaagaacaaagctggaggca

SEQ ID NO: 65955 - DNA, 201 bp, Homo sapiens
ggagaggagtcctttgtggttagctgtttctagaacatgaaaatgtagagagatttcttaaatgtcttcactttccaggagcactggactgaggtaaagtycagcatcgccagtctcatcccccttgtgtttaagaaaaatgaatatcactcattgctgaacaacctaaaagtgattctaaagctcccgggtggggcaaag

SEQ ID NO: 65956 - DNA, 201 bp, Homo sapiens
attgttacatggtttgttgttaacgattatgaaaggataattaaccttctattgtcaaaaatttataatttaccagataatttaatgaggtaataaaaatrtttagtgtgggaaactcagtattatggttgtcaagtggggataaattttgggcagcatagtcttttaaaagtcttggatcacatcattcaagtggatagt

SEQ ID NO: 65957 - DNA, 201 bp, Homo sapiens
aagatgctgtagactccaagagaatggattctgtgatcaggtaagtcttgaaaatgccacaaggagtgctaaatatcctgagaaaattgatgaaaaaaaamccttattgactttgtttgaagtacaaaacattatttgttcataggcctgccccctcttttaattgttattgctataaaactcggtgatttcataataccc

SEQ ID NO: 65958 - DNA, 201 bp, Homo sapiens
ttattttcttgtattaggttcaattcattcattgatattatttgactggctctgtaggcattttattctgcaaacacttatgacaagtctgatcaatttgygcaccagccaaatatctgcaggatgcctacggttcccctcatatctcacaggctgcattctctggaacattctgtgtgcatgaagtgtattgatataaga

SEQ ID NO: 65959 - DNA, 201 bp, Homo sapiens
ctattccagtgtgtatatataccacattttctttattcatttattcattgatggacatttaagttgattttatatcttggcttttgtgaataatgctgcaraaaacataagggtgtggtgcagatatctcttccacatgctgatttcatttccttacccagtagtggaatttctggatcatatggtagttctattttcaat

SEQ ID NO: 65960 - DNA, 201 bp, Homo sapiens
taatgtttctgtgaacattaaatgatataacccatgtgaagccctaagcacagtgcctgatacccagtaagactttgatacattttatttattggtaatgycctgtattattattccactaaagagttctacaatgtgggacttactattccccacattttctatataaagaatttgtggcataaagaatttaaataattg

SEQ ID NO: 65961 - DNA, 201 bp, Homo sapiens
gtcccaagatgtagagcaaagagtgtggggaagaagaaacagaaaggaggggaaagggaaaggaaaagagggaaaggaaagagagaggagaaaagggaagtttttttttttgttgtttgtttgtttgtttaacaaaaaaacaaaaattagaatcacttttataacatagctattgaccttaggctggttttcaggttagat

SEQ ID NO: 65962 - DNA, 201 bp, Homo sapiens
gccaccatggcacatgtatacctatgtaacaagcctgaatgttcagcacatgtatcccagaacttaaggtggaaaaaaaaaaaaagaatgtatgtcattcyttaagagtaactatggcttttatgtaaaatgggttctctttaattcagtatagtctctgaatttttttattgccttaaaaactgagggtgagttttattt

SEQ ID NO: 65963 - DNA, 201 bp, Homo sapiens
tctgtgccttagtttcctcaactgaaaataggcttcatcttagttatcatcataatgtttctgtgaacattaaatgatataacccatgtgaagccctaagsacagtgcctgatacccagtaagactttgatacattttatttattggtaatgtcctgtattattattccactaaagagttctacaatgtgggacttactat

SEQ ID NO: 65964 - DNA, 201 bp, Homo sapiens
tttcatataattttaaatgattctgacaattttatttatattagcatccttcatagagcactgtagaaagtaggaactcaataaatagctattgatataatttgatttttgaaagtatttttaagtgaaatgagactaaagatttgaagttactcaaaaataaaacttatatatcacaagatattacattcttaataattg

SEQ ID NO: 65965 - DNA, 201 bp, Homo sapiens
caaatcttttgctttttaacaatgctgcaagaatatgcttgaaaatatgtcattttacatatatgaatatatctgtggatgattttctagaagctgaattkttaagccaaattttaagccaatttttaatcatctgtgagatgactttctagaagctaaatttttaaagggtatatgccttttaataataataattatttt

SEQ ID NO: 65966 - DNA, 201 bp, Homo sapiens
gacaggtaggtgggggccagaccacagaccatctagtaaactatgctaaggactcggcatttatttaatcagaaatagggagctattgaaatattttaatcaatcattctgaattatataattttatatcctatattacctcttcaatgttcatatttatttgtattattcttaaagtgattgttctagaagttacaatgc

SEQ ID NO: 65967 - DNA, 201 bp, Homo sapiens
gtcatacagtagtaagtgttataaaaaatgaaatagagtgagagatgagagactcagagagtcttcagatagggtggtcagggaaggcttgcctgagtagrtgacatttaagcagataatttttttcttcatttatgtgacagatatttattgaacactcaatatgtataggtcactatgcttgctactgtacggttacag

SEQ ID NO: 65968 - DNA, 201 bp, Homo sapiens
ggctgcttttaaaatacttctctttagccttggttttcagatgttttactgtgatgagtctaagtactgttttttttgtgtgtgtatttatgctacttggrgttcatagaaatttatcaaatgcatcttttttcaattttgaatacttctcagccattatcttttttcaaattatgttttattctcattcctgctctcttc

SEQ ID NO: 65969 - DNA, 201 bp, Homo sapiens
ggaaggacatatcaaggttgaggaaggagcagaagtcaaaatgaacccaagttggctacaatgaatgacttcagatattgagacattaactgagttttacatttaccgtcgttagtagaggtaaagtcaaatgtgtttggaatgtgttaagtttggggtactgatgcaccatttacaaataaagttctggaggactgaagc

SEQ ID NO: 65970 - DNA, 201 bp, Homo sapiens
aattttgaatacttctcagccattatcttttttcaaattatgttttattctcattcctgctctcttctgttatggaatagcaattacacatatgttagactgtttaattatatcacaaatgtttttgatgctcttttaataagtggaattaaataatggaataaataaaatggaaaaacattttatttccttaggttggct

SEQ ID NO: 65971 - DNA, 201 bp, Homo sapiens
attttgaatacttctcagccattatcttttttcaaattatgttttattctcattcctgctctcttctgttatggaatagcaattacacatatgttagactgtttaattatatcacaaatgtttttgatgctcttttaataagtggaattaaataatggaataaataaaatggaaaaacattttatttccttaggttggctt

SEQ ID NO: 65972 - DNA, 201 bp, Homo sapiens
gtggcagaaggaagccacagatgaattcttcatatgggcagggaaaaagtgtgggcaaagaggtggggttaatggctgggcagaaataaccaaaatacctmaaagactctaataaattctcaaagagaattttttcccctggatttcttattaaaatttcctgtaacttccccaaagtttttaaaagatgttttctttctt

SEQ ID NO: 65973 - DNA, 201 bp, Homo sapiens
atattttatattgaccagtctgcttttaagcccatctaatcagttcccagtttcagattatatatgtatgtatatctgaaattatatatatacacacatatatatatatatagaatcttttatacagattctagttctcagttaaatttttctcatccattttgttcatcttttccctctgtttttgaaacatgtttataa

SEQ ID NO: 65974 - DNA, 201 bp, Homo sapiens
tcttaaagtcttccagctgcagtggtaggctggtgtggtgagaagacaagaaagcttaagttagaaactataagtgaatgatccctaaagatatagaaacragatgtacaaaataattctttatttttcagactattatagtcttcagagttcttaaaagtttgaggaataattctgtagaaaaattcttccagcaaagag

SEQ ID NO: 65975 - DNA, 201 bp, Homo sapiens
tatattgaccagtctgcttttaagcccatctaatcagttcccagtttcagattatatatgtatgtatatctgaaattatatatatacacacatatatatayatatagaatcttttatacagattctagttctcagttaaatttttctcatccattttgttcatcttttccctctgtttttgaaacatgtttataatggtaa

SEQ ID NO: 65976 - DNA, 201 bp, Homo sapiens
ccctggaagagctgcctgaagtgaataaacctgctttccttctagaccctgagaaatactttaggaaagaaccagaggaagagcgtccccaaattctggargccccgtcactttttaaaagtaagttctcagccatcatacacctctattatccctcttcaggaaacttagtcatttaaaaatagagtagaagagcatgaa

SEQ ID NO: 65977 - DNA, 201 bp, Homo sapiens
tattgaccagtctgcttttaagcccatctaatcagttcccagtttcagattatatatgtatgtatatctgaaattatatatatacacacatatatatatakatagaatcttttatacagattctagttctcagttaaatttttctcatccattttgttcatcttttccctctgtttttgaaacatgtttataatggtaatt

SEQ ID NO: 65978 - DNA, 201 bp, Homo sapiens
attttttgagacagagtcttgctctgttgcccaggctggagtgcagtgggatgatcctgtctcactgcaaccgctgcctctcaggttcaagtgattctcckctcttagccttccgagtagctgtggttacaggtgtgcaccaccatgctcggctaatttttttgtttgtttgtttgtttgagatggagtctcactctgtca

SEQ ID NO: 65979 - DNA, 201 bp, Homo sapiens
attgaccagtctgcttttaagcccatctaatcagttcccagtttcagattatatatgtatgtatatctgaaattatatatatacacacatatatatatatrtagaatcttttatacagattctagttctcagttaaatttttctcatccattttgttcatcttttccctctgtttttgaaacatgtttataatggtaattt

SEQ ID NO: 65980 - DNA, 201 bp, Homo sapiens
ggagccctggaagagctgcctgaagtgaataaacctgctttccttctagaccctgagaaatactttaggaaagaaccagaggaagagcgtccccaaattcyggaggccccgtcactttttaaaagtaagttctcagccatcatacacctctattatccctcttcaggaaacttagtcatttaaaaatagagtagaagagca

SEQ ID NO: 65981 - DNA, 201 bp, Homo sapiens
cagtctgcttttaagcccatctaatcagttcccagtttcagattatatatgtatgtatatctgaaattatatatatacacacatatatatatatatagaaycttttatacagattctagttctcagttaaatttttctcatccattttgttcatcttttccctctgtttttgaaacatgtttataatggtaatttttaaag

SEQ ID NO: 65982 - DNA, 201 bp, Homo sapiens
actcttggacactctggctctcactcttttctattatcacctggctagcaggcattttgttaaaagatagggcttgattagtataaacaaatatcactacytcggttcacaggaatagattttttgtttttgtttttgttttttttggtcaaagatacacatagccagaaagagtttctccatccctgtggttaataatgt

SEQ ID NO: 65983 - DNA, 201 bp, Homo sapiens
aaaaagccctcatgagaataattttattttttcccttctgttcaagacaggagaagagtcatcagagctgggtcagttttacaaattgaaggctagcaaakctggggaaaacggttttctagttccttctgcttgcactacttcttttttttaatttttattttttaaaggattgacttttatcaagctgtcttgaatata

SEQ ID NO: 65984 - DNA, 201 bp, Homo sapiens
tactgtattacctatttttattattttcatttaaaattgttcctctccttttcagaaggatactgatgaatttaaaaattgttattataaaataacacttaaaaaaaaaaaaaacttcaattaccaatatatttctcctgcacactatcattgcagaggctaccttacgtctttgcactgcattttttccactttgctgca

SEQ ID NO: 65985 - DNA, 201 bp, Homo sapiens
agggagctccttagaaatgcagcatctcaggacccaccccagatctgttgcatgggaatttgtattttaatgagaactccaggtgattcttatgcacatawaagtttgataaataagaatttgtctagaagacgcaaaataggacacagaataggaggaagaatgtgaattagaaaggagttttcagaatgctgtacactc

SEQ ID NO: 65986 - DNA, 201 bp, Homo sapiens
gtagggtttgcagatcactgcagctgtaccagctgagtaacaggaaggttaaatttataaaagttaacttggaaatgtgctggctctttccaaggagttawtgatattgtaccctttttctccctgtcttcctctaaaacctgctgttgtgaaggtacatttaggtcattaaacattggagccctggaagagctgcctgaa

SEQ ID NO: 65987 - DNA, 201 bp, Homo sapiens
ttcttacttactaatgagcaattgcattgattcaaatcttttgctttttaacaatgctgcaagaatatgcttgaaaatatgtcattttacatatatgaatrtatctgtggatgattttctagaagctgaatttttaagccaaattttaagccaatttttaatcatctgtgagatgactttctagaagctaaatttttaaag

SEQ ID NO: 65988 - DNA, 201 bp, Homo sapiens
aaaaatatgaaagaaaaataaaaatgtgaaagaatttagactacaggagaaaaagtacacttggtgtatatatgcaggtgggggtatgtttagatgggggktggtgcacaggaagaaagatgaaggaaaatagaaaaagtctaaagaaaatagaagaaacaagaaacatgaagaaaaaattaagtgtcttaaagctatttt

SEQ ID NO: 65989 - DNA, 201 bp, Homo sapiens
ccctgcatccatagttcctgtttaaaatcctgctcttaatgttattgatgcatcttattctggctgcttttaaaatacttctctttagccttggttttcaratgttttactgtgatgagtctaagtactgttttttttgtgtgtgtatttatgctacttggggttcatagaaatttatcaaatgcatcttttttcaatttt

SEQ ID NO: 65990 - DNA, 201 bp, Homo sapiens
attcattttcacaagatgacacaatcattcagtagcagtagttgtgatactctcagggtggcaaatgtggagtgtgtaatggaactagtaaactccttcartgccaggaaaacaagtctctcagactcctaaaatggccttaaaattggctcattctgaactttaattttacttggcaaaagtataaacttaaaaacagtt

SEQ ID NO: 65991 - DNA, 201 bp, Homo sapiens
tttgaaaacatttaaggaggtaacacgcaaataaagtagttgagggaataaataagtgtggcaattctttaacaaaagctttgttttgtttttagtaaatrtacatctggctattcagaattttaaaatgggaatggtaaaaaaatttttgtagttcattattatctcttcagagaatttttgtttcttatgacatatctc

SEQ ID NO: 65992 - DNA, 201 bp, Homo sapiens
tttattttgaacagctgtgtttgtagggtttgcagatcactgcagctgtaccagctgagtaacaggaaggttaaatttataaaagttaacttggaaatgtrctggctctttccaaggagttaatgatattgtaccctttttctccctgtcttcctctaaaacctgctgttgtgaaggtacatttaggtcattaaacattgg

SEQ ID NO: 65993 - DNA, 201 bp, Homo sapiens
agtttcaggttaggttttgaggggaaagtggtagctaactagtttttcaacattttgacacacaaggtcaaatatcagaaagactattttttatgtcatgktataagaaagattttgtgcttttggtgttaattctctgactatacctagtatgtcaatttaatatgagtatcttggcaaaaagacattagatgttgaatt

SEQ ID NO: 65994 - DNA, 201 bp, Homo sapiens; identical to SEQ ID NO: 28810

SEQ ID NO: 65995 - DNA, 201 bp, Homo sapiens; identical to SEQ ID NO: 28811

SEQ ID NO: 65996 - DNA, 201 bp, Homo sapiens; identical to SEQ ID NO: 28812

SEQ ID NO: 65997 - DNA, 201 bp, Homo sapiens; identical to SEQ ID NO: 28720

SEQ ID NO: 65998 - DNA, 201 bp, Homo sapiens; identical to SEQ ID NO: 28722

SEQ ID NO: 65999 - DNA, 201 bp, Homo sapiens; identical to SEQ ID NO: 28724

SEQ ID NO: 66000 - DNA, 201 bp, Homo sapiens; identical to SEQ ID NO: 28725

SEQ ID NO: 66001 - DNA, 201 bp, Homo sapiens; identical to SEQ ID NO: 28727

SEQ ID NO: 66002 - DNA, 201 bp, Homo sapiens; identical to SEQ ID NO: 28729

SEQ ID NO: 66003 - DNA, 201 bp, Homo sapiens; identical to SEQ ID NO: 28730

SEQ ID NO: 66004 - DNA, 201 bp, Homo sapiens; identical to SEQ ID NO: 28732

SEQ ID NO: 66005 - DNA, 201 bp, Homo sapiens; identical to SEQ ID NO: 28733

SEQ ID NO: 66006 - DNA, 201 bp, Homo sapiens; identical to SEQ ID NO: 28734

SEQ ID NO: 66007 - DNA, 201 bp, Homo sapiens; identical to SEQ ID NO: 28735

SEQ ID NO: 66008 - DNA, 201 bp, Homo sapiens; identical to SEQ ID NO: 28736

SEQ ID NO: 66009 - DNA, 201 bp, Homo sapiens; identical to SEQ ID NO: 28737

SEQ ID NO: 66010 - DNA, 201 bp, Homo sapiens; identical to SEQ ID NO: 28740

SEQ ID NO: 66011 - DNA, 201 bp, Homo sapiens; identical to SEQ ID NO: 28741

SEQ ID NO: 66012 - DNA, 201 bp, Homo sapiens; identical to SEQ ID NO: 28743

SEQ ID NO: 66013 - DNA, 201 bp, Homo sapiens; identical to SEQ ID NO: 28745

SEQ ID NO: 66014 - DNA, 201 bp, Homo sapiens; identical to SEQ ID NO: 28747

SEQ ID NO: 66015 - DNA, 201 bp, Homo sapiens; identical to SEQ ID NO: 28749

SEQ ID NO: 66016 - DNA, 201 bp, Homo sapiens; identical to SEQ ID NO: 28752

SEQ ID NO: 66017 - DNA, 201 bp, Homo sapiens; identical to SEQ ID NO: 28847

SEQ ID NO: 66018 - DNA, 201 bp, Homo sapiens; identical to SEQ ID NO: 28848

SEQ ID NO: 66019 - DNA, 201 bp, Homo sapiens; identical to SEQ ID NO: 28849

SEQ ID NO: 66020 - DNA, 201 bp, Homo sapiens; identical to SEQ ID NO: 28850

SEQ ID NO: 66021 - DNA, 201 bp, Homo sapiens; identical to SEQ ID NO: 28865

SEQ ID NO: 66022 - DNA, 201 bp, Homo sapiens; identical to SEQ ID NO: 28864

SEQ ID NO: 66023 - DNA, 201 bp, Homo sapiens; identical to SEQ ID NO: 28758

SEQ ID NO: 66024 - DNA, 201 bp, Homo sapiens; identical to SEQ ID NO: 28867

SEQ ID NO: 66025 - DNA, 201 bp, Homo sapiens; identical to SEQ ID NO: 28760

SEQ ID NO: 66026 - DNA, 201 bp, Homo sapiens; identical to SEQ ID NO: 28762

SEQ ID NO: 66027 - DNA, 201 bp, Homo sapiens; identical to SEQ ID NO: 28761

SEQ ID NO: 66028 - DNA, 201 bp, Homo sapiens; identical to SEQ ID NO: 28765

SEQ ID NO: 66029 - DNA, 201 bp, Homo sapiens; identical to SEQ ID NO: 28874

SEQ ID NO: 66030 - DNA, 201 bp, Homo sapiens; identical to SEQ ID NO: 28766

SEQ ID NO: 66031 - DNA, 201 bp, Homo sapiens; identical to SEQ ID NO: 28875

SEQ ID NO: 66032 - DNA, 201 bp, Homo sapiens; identical to SEQ ID NO: 28876

SEQ ID NO: 66033 - DNA, 201 bp, Homo sapiens; identical to SEQ ID NO: 28878

SEQ ID NO: 66034 - DNA, 201 bp, Homo sapiens; identical to SEQ ID NO: 28879

SEQ ID NO: 66035 - DNA, 201 bp, Homo sapiens; identical to SEQ ID NO: 28774

SEQ ID NO: 66036 - DNA, 201 bp, Homo sapiens; identical to SEQ ID NO: 28776

SEQ ID NO: 66037 - DNA, 201 bp, Homo sapiens; identical to SEQ ID NO: 28880

SEQ ID NO: 66038 - DNA, 201 bp, Homo sapiens; identical to SEQ ID NO: 28881

SEQ ID NO: 66039 - DNA, 201 bp, Homo sapiens; identical to SEQ ID NO: 28883

SEQ ID NO: 66040 - DNA, 201 bp, Homo sapiens; identical to SEQ ID NO: 28886

SEQ ID NO: 66041 - DNA, 201 bp, Homo sapiens; identical to SEQ ID NO: 28888

SEQ ID NO: 66042 - DNA, 201 bp, Homo sapiens; identical to SEQ ID NO: 28890

SEQ ID NO: 66043 - DNA, 201 bp, Homo sapiens; identical to SEQ ID NO: 28894

SEQ ID NO: 66044 - DNA, 201 bp, Homo sapiens; identical to SEQ ID NO: 28897

SEQ ID NO: 66045 - DNA, 201 bp, Homo sapiens; identical to SEQ ID NO: 28898

SEQ ID NO: 66046 - DNA, 201 bp, Homo sapiens; identical to SEQ ID NO: 28788

SEQ ID NO: 66047 - DNA, 201 bp, Homo sapiens; identical to SEQ ID NO: 28792

SEQ ID NO: 66048 - DNA, 201 bp, Homo sapiens; identical to SEQ ID NO: 28906

SEQ ID NO: 66049 - DNA, 201 bp, Homo sapiens; identical to SEQ ID NO: 28908

SEQ ID NO: 66050 - DNA, 201 bp, Homo sapiens; identical to SEQ ID NO: 28909

SEQ ID NO: 66051 - DNA, 201 bp, Homo sapiens; identical to SEQ ID NO: 28910

SEQ ID NO: 66052 - DNA, 201 bp, Homo sapiens; identical to SEQ ID NO: 28911

SEQ ID NO: 66053 - DNA, 201 bp, Homo sapiens; identical to SEQ ID NO: 28913

SEQ ID NO: 66054 - DNA, 201 bp, Homo sapiens; identical to SEQ ID NO: 28912

SEQ ID NO: 66055 - DNA, 201 bp, Homo sapiens; identical to SEQ ID NO: 28914

SEQ ID NO: 66056 - DNA, 201 bp, Homo sapiens; identical to SEQ ID NO: 28917

SEQ ID NO: 66057 - DNA, 201 bp, Homo sapiens; identical to SEQ ID NO: 28916

SEQ ID NO: 66058 - DNA, 201 bp, Homo sapiens; identical to SEQ ID NO: 28918

SEQ ID NO: 66059 - DNA, 201 bp, Homo sapiens; identical to SEQ ID NO: 28804

SEQ ID NO: 66060 - DNA, 201 bp, Homo sapiens; identical to SEQ ID NO: 28920

SEQ ID NO: 66061 - DNA, 201 bp, Homo sapiens; identical to SEQ ID NO: 28921

SEQ ID NO: 66062 - DNA, 201 bp, Homo sapiens; identical to SEQ ID NO: 19168

SEQ ID NO: 66063 - DNA, 201 bp, Homo sapiens; identical to SEQ ID NO: 19037

SEQ ID NO: 66064 - DNA, 201 bp, Homo sapiens
caccgggcagcttcaacctcagctccagtctctccctgggtcccactctccccaagccattatggccacagtagtcgcggggttccccctcaccaatgtcrttgtggtgagcaagcgtgtcagcgctgtagtccttgtgtaggatgaggttttccacctcaaacttcatctccccttgcgtgttggagttaagccttgagc

SEQ ID NO: 66065 - DNA, 201 bp, Homo sapiens
ggttgtctgggttcctggcaacacagaaagataggggatgtcattccaacccagagggccttccctgcctcctcccctcagggaagactcaaccagaggcygcacttctcttgtgctatggccagccctctgggagaaggggatggtaacaaggtttctgggaagctgtagggagggcttttggtccttgttgcccccacc

SEQ ID NO: 66066 - DNA, 201 bp, Homo sapiens
ccactgcactccagcctgggcgacagagcgatactccatctcaaaaaaaaaaaaaacaaaaaaaacaaaagcaaaaacagaaaaagcacagtgcttgatcrtggaggcactaataggaggcagtctctggagtgagaatctggaactgtgaaactggttgctggagaagcggctgatgcctgctagcctggggtgagatct

SEQ ID NO: 66067 - DNA, 201 bp, Homo sapiens
ggctgccaacggacattttaaagatgtcgtttcagacctgccagaagactggacagggtctccttccaaccccacctcacatttgtgtggccactgtttcrtgagcgtgtgtgtgtgtttatgcttgtcacatagggatgaagatgtcacccaccctacctccagctcctaactcctgcctgctcttgcctcccacccatc

SEQ ID NO: 66068 - DNA, 201 bp, Homo sapiens
gagtcaggaccacccctccatcctggccagaggggtctgggcagccagcacccaggcctatgcctgagggtaaagctattgtcgttcaccctggtgggtgscacaggcaaatccatctgtgcagagcctatcttcccagtctcttcttacagctgatggagatgactctactgcaaaaatgacaaccagcaagaaagcggg

SEQ ID NO: 66069 - DNA, 201 bp, Homo sapiens
gcctttactccacctatagcccctaccatctatttacctttgcagcccatcgctccctaaacaacactcttcatccatccctggacccatctgccaccgcytcagtgctcccacctctaactctgcagtcttcccttgatcacactgggctcattttcaggtcaaaacactcctcaggaccttctaagtcagtcgcaattg

SEQ ID NO: 66070 - DNA, 201 bp, Homo sapiens
tcagtcatccagggaggtctgctggtcgcttatcacctggaaacctcccctgccccatgccccaagggctttgttccaggtgttgaaaaaggcttggatgkccagagccactgcatacagctgtacaggtcgtttctgcaaaaactcccagctgaggtagttaggctggaatccatcccaaggctccattctccaagttct

SEQ ID NO: 66071 - DNA, 201 bp, Homo sapiens
cttggacaagcggctttaggcccacctgcacatagcaccagggtcgcctccggttgtctgggttcctggcaacacagaaagataggggatgtcattccaayccagagggccttccctgcctcctcccctcagggaagactcaaccagaggccgcacttctcttgtgctatggccagccctctgggagaaggggatggtaac

SEQ ID NO: 66072 - DNA, 201 bp, Homo sapiens
gtgttgaaaaaggcttggatggccagagccactgcatacagctgtacaggtcgtttctgcaaaaactcccagctgaggtagttaggctggaatccatcccraggctccattctccaagttctatatcctagcacagacagaggctgcatcccacaaaggaaggtgtgtctttttctaattcatataaacagggccttccca

SEQ ID NO: 66073 - DNA, 201 bp, Homo sapiens
tatcacctggaaacctcccctgccccatgccccaagggctttgttccaggtgttgaaaaaggcttggatggccagagccactgcatacagctgtacaggtygtttctgcaaaaactcccagctgaggtagttaggctggaatccatcccaaggctccattctccaagttctatatcctagcacagacagaggctgcatccc

SEQ ID NO: 66074 - DNA, 201 bp, Homo sapiens
cagccctctgggagaaggggatggtaacaaggtttctgggaagctgtagggagggcttttggtccttgttgcccccacctcacctgcagtaattatgtttycccaggcccagctgaagagcatcagatctgtgggcatggtacgtttgctgaaggacagtggcagagttccagggcaggcagggccggcccatggtgtcag

SEQ ID NO: 66075 - DNA, 201 bp, Homo sapiens
cttcttttttttttttttttgagacagggtcttgctctgtcacctaggctggagtgcagtggcacaatcagctgactgtaaacttgaactccttggcttakgatcctcctgcctcagcctcccaagtagctaggactacagacatgtgctaccacacctggctaatttttttattttttgcagagacagggtctcactaag

SEQ ID NO: 66076 - DNA, 201 bp, Homo sapiens
ggcacaatcagctgactgtaaacttgaactccttggcttatgatcctcctgcctcagcctcccaagtagctaggactacagacatgtgctaccacacctgrctaatttttttattttttgcagagacagggtctcactaagtttcccaggctggtctcaaactcctgggctcaagcgattctcccacctcagcctctcaaa

SEQ ID NO: 66077 - DNA, 201 bp, Homo sapiens
gccccctaatcataggcatagcaatggctggtcacaagctctgttaacacactgagaaaattccagcatcagtcccacacacagatgatgggaaattatgktttttgtttcctgaatgccacagagtcaagctggcattctggataagcaattttctttctttctttatttttttatttatttgaggcgaagtcttccctc

SEQ ID NO: 66078 - DNA, 201 bp, Homo sapiens
aaaagtgaccattcccctcatagcaggtttttgacttatctacaaggggacaggaggatgagagaatatgagaaagagaagaacattccaactaacttttwttttttttttttgagatggagtcttgctctgtcgcccagttggagtgcagtggtgtgatctcagctcactgagatctctgcctcccaggttcaagcaatt

SEQ ID NO: 66079 - DNA, 201 bp, Homo sapiens
tcgctggagagaacaaaggtggggtaagcgagggggagtggaagtggtaaggggtggcgcagccctgcagcagagggcagggaggggatgtcccctgaagycttcccaacttgtctgtgcagccaactgttgtaggggtggatactcacatggaacttgatgaagttcattgctgccctggaagagattcgggaggaggct

SEQ ID NO: 66080 - DNA, 201 bp, Homo sapiens
tcagtaacatgttgagtcaggaccacccctccatcctggccagaggggtctgggcagccagcacccaggcctatgcctgagggtaaagctattgtcgttcrccctggtgggtggcacaggcaaatccatctgtgcagagcctatcttcccagtctcttcttacagctgatggagatgactctactgcaaaaatgacaacca

SEQ ID NO: 66081 - DNA, 201 bp, Homo sapiens
caccatgttggccaggccggtctcaaactcctggcctcaagtgatccatccacctcggcctcccaaagtgctgggattacaggcatgagccactgtgcctsacgcagccccattttctaccacatcaagtttaaaatcccctgcttggctttaaaagccctgtcatctgccactattccatccacactcccagaccctagt

SEQ ID NO: 66082 - DNA, 201 bp, Homo sapiens
ggcaaacacataaggactggtttaaaccctcaaagacctgagctcctgattctggctacttagggctttggctagagagagacacccttaagctggctggracaagcccaggagctctggggagatatggaagaggtggagagagatgcttggaacactcacctggcaggaatctgttttccactgtgggtcagcagcaca

SEQ ID NO: 66083 - DNA, 201 bp, Homo sapiens
gatctcacagcttgtgccaaactggggatcgttatacatcgagggcaggcagatggtctgtatagtccgggatggctgcgcacacctgccctccttggaayggatcttcagcaaggctgggggaggacagagggtcagaggagaaagatcactactggttaggcggtccccatctgtcccctccaagtgccgaggaagtag

SEQ ID NO: 66084 - DNA, 201 bp, Homo sapiens
agaacaaaggtggggtaagcgagggggagtggaagtggtaaggggtggcgcagccctgcagcagagggcagggaggggatgtcccctgaagccttcccaayttgtctgtgcagccaactgttgtaggggtggatactcacatggaacttgatgaagttcattgctgccctggaagagattcgggaggaggcttcatcaaag

SEQ ID NO: 66085 - DNA, 201 bp, Homo sapiens
gttttccacctcaaacttcatctccccttgcgtgttggagttaagccttgagcgacccaggtagacgatgtagtcctccttctttgggtaatcactgtggragaagatacccatcaaacagcttagtcccatgaaatctgccacttcttccttccctccctagaggcctcaaagcacgacttgtccccaaggccatgggct

SEQ ID NO: 66086 - DNA, 201 bp, Homo sapiens
gtccacacagtttaaggaaatatttagacttaacaatcagacaccagctcttactcacacttacactcacagcccacacacaagtgtgcaaacatacacamacatatatatttcctgatacattcatggaatatcagagccctgccctgaagtcgttagtgtctctgctccccaaaccgctgctcccacattggctaagct

SEQ ID NO: 66087 - DNA, 201 bp, Homo sapiens
gtacttgttggacacacatgttcctccatttagacagtcacagttcgctggagagaacaaaggtggggtaagcgagggggagtggaagtggtaaggggtggcgcagccctgcagcagagggcagggaggggatgtcccctgaagccttcccaacttgtctgtgcagccaactgttgtaggggtggatactcacatggaact

SEQ ID NO: 66088 - DNA, 201 bp, Homo sapiens
gcttcccaaagtgctggattacaggcgtgagccactgagcctggccagcaattttcacttacaggtcttcttcttcttcttcttcttttttttttttttttgagacagggtcttgctctgtcacctaggctggagtgcagtggcacaatcagctgactgtaaacttgaactccttggcttatgatcctcctgcctcagcct

SEQ ID NO: 66089 - DNA, 201 bp, Homo sapiens
accaccatgccaggctgatttttgcatttttagtagaggcagggttacaccatgttgtccaggctggtcttgaactcctgacctcaaatgatccactcaamcttgacctctcaaaatgctgggattacaagcgtgagccaccatgcccggctgccaacggacattttaaagatgtcgtttcagacctgccagaagactgga

SEQ ID NO: 66090 - DNA, 201 bp, Homo sapiens
tccacacacctcggcttcccaaagtgctggattacaggcgtgagccactgagcctggccagcaattttcacttacaggtcttcttcttcttcttcttcttytttttttttttttgagacagggtcttgctctgtcacctaggctggagtgcagtggcacaatcagctgactgtaaacttgaactccttggcttatgatcct

SEQ ID NO: 66091 - DNA, 201 bp, Homo sapiens
gagggccaggccattctcttccttggtgtgactgcggatccagggtaagaagtgtgagactctcgtgtagacgcctggcttgtccttcagggcacatccamggccccagctcacaattccagtcaaagtcatgcggccttggagggaacagacgaggggtccccctgagtctccctgtgacgccaaagatacaaaagatga

SEQ ID NO: 66092 - DNA, 201 bp, Homo sapiens
agaactcatgctgaccatatcttgaatttttctgggcacttcatatattctgaccaattgtccccaaaggctgtcaatcagtggtgcatgttagtaacacygagggagcttttctaaaaccacgagacctggagccagccctgacctgaatcacaatctctacaggtggagtgtaggtgtgcatattttaaaaggtcctca

SEQ ID NO: 66093 - DNA, 201 bp, Homo sapiens
caccaccatgccaggctgatttttgcatttttagtagaggcagggttacaccatgttgtccaggctggtcttgaactcctgacctcaaatgatccactcamacttgacctctcaaaatgctgggattacaagcgtgagccaccatgcccggctgccaacggacattttaaagatgtcgtttcagacctgccagaagactgg

SEQ ID NO: 66094 - DNA, 201 bp, Homo sapiens
gtgcagtggtgtgatctcagctcactgagatctctgcctcccaggttcaagcaattctcctgcctcagcctcccaagtagctgggactacaggcatccacyaccatgccaggctgatttttgcatttttagtagaggcagggttacaccatgttgtccaggctggtcttgaactcctgacctcaaatgatccactcaaact

SEQ ID NO: 66095 - DNA, 201 bp, Homo sapiens
cagcatcagtcccacacacagatgatgggaaattatgttttttgtttcctgaatgccacagagtcaagctggcattctggataagcaattttctttctttmtttatttttttatttatttgaggcgaagtcttccctctgtcgcccaggctggagtgcagtggtgcgatctcggctcactgcaacctctgcctcccgggtt

SEQ ID NO: 66096 - DNA, 201 bp, Homo sapiens
ttatctacaaggggacaggaggatgagagaatatgagaaagagaagaacattccaactaacttttattttttttttttgagatggagtcttgctctgtcgyccagttggagtgcagtggtgtgatctcagctcactgagatctctgcctcccaggttcaagcaattctcctgcctcagcctcccaagtagctgggactaca

SEQ ID NO: 66097 - DNA, 201 bp, Homo sapiens
attccagcatcagtcccacacacagatgatgggaaattatgttttttgtttcctgaatgccacagagtcaagctggcattctggataagcaattttctttmtttctttatttttttatttatttgaggcgaagtcttccctctgtcgcccaggctggagtgcagtggtgcgatctcggctcactgcaacctctgcctcccg

SEQ ID NO: 66098 - DNA, 201 bp, Homo sapiens
ctcaggtgatccacacacctcggcttcccaaagtgctggattacaggcgtgagccactgagcctggccagcaattttcacttacaggtcttcttcttcttyttcttcttttttttttttttttgagacagggtcttgctctgtcacctaggctggagtgcagtggcacaatcagctgactgtaaacttgaactccttggct

SEQ ID NO: 66099 - DNA, 201 bp, Homo sapiens
gaatttttctgggcacttcatatattctgaccaattgtccccaaaggctgtcaatcagtggtgcatgttagtaacactgagggagcttttctaaaaccacragacctggagccagccctgacctgaatcacaatctctacaggtggagtgtaggtgtgcatattttaaaaggtcctcagatgactcgattaagaaacactg

SEQ ID NO: 66100 - DNA, 201 bp, Homo sapiens
aaggggacatgtaagtttgtccccttccaccccactgtcatcagcaggtcagtgatgctcaccatctgcgcagtcatgcaccatgcactcttggacaagcrgctttaggcccacctgcacatagcaccagggtcgcctccggttgtctgggttcctggcaacacagaaagataggggatgtcattccaacccagagggcct

SEQ ID NO: 66101 - DNA, 201 bp, Homo sapiens
cagcctcgagctcctgggctcaagcaatcctcccgtctaggcctcccacagtattaggattacaggtgtgagccattgcacctagcccagaattgattttyaaaaaacacctcagcaactcctcttacttcatctaattcaaagggagggcttaaatgtttccttcttggaaggaaggtggacccaatgggagtgagtatg

SEQ ID NO: 66102 - DNA, 201 bp, Homo sapiens
atctgccacttcttccttccctccctagaggcctcaaagcacgacttgtccccaaggccatgggctgcatggacaggggcagatgagggagaaatgaggcrgaacactttgctgggaaggagaaagggatgtgcttggggtggggcagaagagtcgaagaggagaaacccagggccgtacatgaagcagtgtgtggcgctg

SEQ ID NO: 66103 - DNA, 201 bp, Homo sapiens
agcccatcgctccctaaacaacactcttcatccatccctggacccatctgccaccgcctcagtgctcccacctctaactctgcagtcttcccttgatcacrctgggctcattttcaggtcaaaacactcctcaggaccttctaagtcagtcgcaattgtcacttactagaattctcttttccaaagccagtgatctcacag

SEQ ID NO: 66104 - DNA, 201 bp, Homo sapiens
tccttgtgtaggatgaggttttccacctcaaacttcatctccccttgcgtgttggagttaagccttgagcgacccaggtagacgatgtagtcctccttctktgggtaatcactgtggaagaagatacccatcaaacagcttagtcccatgaaatctgccacttcttccttccctccctagaggcctcaaagcacgacttgt

SEQ ID NO: 66105 - DNA, 201 bp, Homo sapiens
acaaggtccagaggaatccacagaggcgcctggtgctctaatggaggtggcagggggcatggcgggagacccgaggaggcatttagaaggagagagctatratccagactccttccctgcccgcaaggagcctccagtctgtgagaagccagactcaggtgctagtcactctgatgaaagggaaacaaagggcactgggag

SEQ ID NO: 66106 - DNA, 201 bp, Homo sapiens
agaaaaacaatgagagatgagtcaaaatacctgcatggtaggtagtgagctctctggcccagaggtaatcaaattgtggtgacatcagactggcaggagcrggatgaggaacaggagtttgggaaaaagggtttttcagttcccctgacgccacctgatcgctgagcttctgttatgtgcatgcaagtggggattcaagaa

SEQ ID NO: 66107 - DNA, 201 bp, Homo sapiens
gacatcagactggcaggagcaggatgaggaacaggagtttgggaaaaagggtttttcagttcccctgacgccacctgatcgctgagcttctgttatgtgcrtgcaagtggggattcaagaattcttaggaaaggtaatcttaggaagaaattgaggacgggaggagacagagaaggatgtggttgggaagcacctggccca

SEQ ID NO: 66108 - DNA, 201 bp, Homo sapiens
gaggagacagagaaggatgtggttgggaagcacctggcccatgggagtgggaggggaagcagataattccctgtctacttcagataccactaatgctattrtaaccattcccatttattgagcaacttctgtgtgctaagccctggcagcatcttaagaatgataataacagttattgaggcttcaaaatacttcacctgc

SEQ ID NO: 66109 - DNA, 201 bp, Homo sapiens
tgggatcttgagggtggagaggctgggaccagatcctgggaacaaggggcgtggggatcagctgtcaagagtgctggagcaggtggtgactgggggttcaraaatgcatctccagaaaggggagaggctgggactctgagtcctctccctaacccaggtactctcctctccttcctttcagaacagcactcctcctccacc

SEQ ID NO: 66110 - DNA, 201 bp, Homo sapiens
gggcatccgccgaccggcctgaccgcgcccgggctgccctcgctcaggaccgtggacgcgctgggtgtgctgaccggggcgcagcttttctcgctgcagarggaggagctgcgggcggtgagccccgaggagggggcacgtgtgtacagccaggtcaccgtgcagcgctcgctgctggaggtgagccggaccgctggtccc

SEQ ID NO: 66111 - DNA, 201 bp, Homo sapiens
tcccctcccgccacttgccagggctgacctcaccgccatcttaaccgggtgtccacctctctctgcctgcctggtgctggccccgcgtccccatcgccgcscccgtctgctcccctcagagggcttgctgacgctgcgggccaagccgccctcggaggccgagtacaccgacgtgctgcagaagatcaagtacgccttcag

SEQ ID NO: 66112 - DNA, 201 bp, Homo sapiens
agcagctaggcccccaagcaggaagcatgtggaaagtcagtttgcccatccataaaatggacctccgttgcctcacctcagtcatggatatgaagccaggrgcctcgggtccacttaatctgccagcctttcctccaggccagctgttgtgctggacagtgggaccacggaggcaaatcaagacacagccctgcatgagga

SEQ ID NO: 66113 - DNA, 201 bp, Homo sapiens
ttgaaagcagctaggcccccaagcaggaagcatgtggaaagtcagtttgcccatccataaaatggacctccgttgcctcacctcagtcatggatatgaagycaggggcctcgggtccacttaatctgccagcctttcctccaggccagctgttgtgctggacagtgggaccacggaggcaaatcaagacacagccctgcat

SEQ ID NO: 66114 - DNA, 201 bp, Homo sapiens
taataacccttccatcgctccccattaccttcgtcatgaagcccttgctgccctgcttggcatttccacaggatctgcccccagtcccacagtctctctcwttcctcttttcttcaccagcccagaagctgccccaaagccaagcgccaagtctatctatggtgagcggggggcaagggagccccaggcccatagaactgg

SEQ ID NO: 66115 - DNA, 201 bp, Homo sapiens
tatctctccaacactttctatgtgctagacccaattctgtgtgctgcagattaagtggaggactgatcacacaaaaatctttgcccttgtgaagcttgcattttttttttttttttttttgagatggagtcttgctctgtcacccaggctggagtgcagtggagcaatcttggctcactgcaatctccacctcccgggttc

SEQ ID NO: 66116 - DNA, 201 bp, Homo sapiens
gagtgcagtggcacgatctggactcactgcaacctccgcctcccaggttcaagtgattctcctgcctcagcctcccacgtagctgggactacaggcgcccrccaccacacccagctaatttttgtatttttagtagagacagggtttcaccatgttggccaagatggtctcaatctcttgactttgtgatccgcccacctc

SEQ ID NO: 66117 - DNA, 201 bp, Homo sapiens
ccacctctgcctcccaaagtgctgggattacaggcgtgagccaccgcgcccagcctacctgtcttcttaaagtccagctctggctctgagctctcctgctctaataataataataataataataataataataataataacccttccatcgctccccattaccttcgtcatgaagcccttgctgccctgcttggcatttcc

SEQ ID NO: 66118 - DNA, 201 bp, Homo sapiens
gggtctggactcctgagtcagagggaagaggtgctgggggtctggactcctgggtcagagggaagaggggctggggggctggactcctaggtttgagggargaggggctgggggcctggactcctgagtcagagggaagaggtgctgggggcctggactcctgggtcagagggaagaggggctggggggctggactcctgg

SEQ ID NO: 66119 - DNA, 201 bp, Homo sapiens
gagtcagagggaagaggtgctgggggtctggactcctgggtcagagggaagaggggctggggggctggactcctaggtttgagggaggaggggctgggggyctggactcctgagtcagagggaagaggtgctgggggcctggactcctgggtcagagggaagaggggctggggggctggactcctgggtcagagggaagag

SEQ ID NO: 66120 - DNA, 201 bp, Homo sapiens
agcgacacagcagggccgaggctgggaagtccgggggcgcggccggtccgcctggccccgcctgacccgactgtcttacttcctacagcaaagcgcccccsaggtcgctgtcaatgggtgagtgtccgccccagggcagggcaagggggtcaaggaggggtgcgtcccgggggctcccgatgctgactccgcccccttttt

SEQ ID NO: 66121 - DNA, 201 bp, Homo sapiens
gggtcagagggaagaggggctggggggctggactcctaggtttgagggaggaggggctgggggcctggactcctgagtcagagggaagaggtgctgggggsctggactcctgggtcagagggaagaggggctggggggctggactcctgggtcagagggaagaggggctggggggctggactcctgggtcagagggaagag

SEQ ID NO: 66122 - DNA, 201 bp, Homo sapiens
cgggcacgacgaacctgtcccgtccccgcacccacgccaaccacctccctccccacgccccaggcccggctgcgcggcaacatcgccgacccctcctctcyggagctgttgcacttccttttcgggcctctgcagatggtgagacccgccccaggccctcgggcccccctgcagcgggaggaatcgggttcgacttgtaga

SEQ ID NO: 66123 - DNA, 201 bp, Homo sapiens
tggcaaggaggcagtagacagagggtttgaatcccggactatgccatggtagagatcacactcccctaccacccagcaccaccgcctgacctgacctgtcttttttttttttttttttttttttgagatggggtctcactctgctgccaggctggagtgcagtggcacgatctggactcactgcaacctccgcctcccagg

SEQ ID NO: 66124 - DNA, 201 bp, Homo sapiens
gaggagttgcagcgcgaccgctcgcccgccgctgagaccccgcccctgcagcgccgcccgtcagtccgcgcagtgatcagcaccgtagagcggggcgcggrccgcggacgaccccaggcgaagcccattcccgaggcagaggaggcgcagaggcctgagccggtggggacctcgagcaacgctgactcggcctccccggac

SEQ ID NO: 66125 - DNA, 201 bp, Homo sapiens
tctgtcccctaggacatcctgaaccacgtgttcgacgacgtagagagctttgtatcgaggctgcagaagtcggcggaggcggccagggtgctggagcaccsggaacgcggccgcaggagccggcgccgggcggctgggggtaaggggcaccctggcgtgggatctgaaccccctcccgatctcttccaaatgtccccgctc

SEQ ID NO: 66126 - DNA, 201 bp, Homo sapiens
ctctgtcccctaggacatcctgaaccacgtgttcgacgacgtagagagctttgtatcgaggctgcagaagtcggcggaggcggccagggtgctggagcacsgggaacgcggccgcaggagccggcgccgggcggctgggggtaaggggcaccctggcgtgggatctgaaccccctcccgatctcttccaaatgtccccgct

SEQ ID NO: 66127 - DNA, 201 bp, Homo sapiens
tgcccgaggctctctgccatcagaccacactatatctctttctctctgttccttcatccccatcaatcgaaggcaaaaatgtgccttctctgatttccagsctcactcagcatagaccgtggaggcaacatatcttgaatgaagcaacaaagcagtaatgcacatgaatgcaccaaatgccaaaagctcgtttactcaaca

SEQ ID NO: 66128 - DNA, 201 bp, Homo sapiens
tacttcagataccactaatgctattgtaaccattcccatttattgagcaacttctgtgtgctaagccctggcagcatcttaagaatgataataacagttaytgaggcttcaaaatacttcacctgcatcatctgactgaatttgcccaacagccctaccagatggttactacgttacagaaagaaaaactgaggcaggaga

SEQ ID NO: 66129 - DNA, 201 bp, Homo sapiens
ggtcctgtgtaattatgacttccaggcccgcaacagcagtgagctgtcggtcaagcagcgggacgtactggaggttagaggagcgggaggctgaggggcasgaattagccagccctagctgcagacaggctctgaaccctctgttctttaccacacccaggtcctggatgacagtcgtaagtggtggaaggttcgggaccc

SEQ ID NO: 66130 - DNA, 201 bp, Homo sapiens
tcacctcagtcatggatatgaagccaggggcctcgggtccacttaatctgccagcctttcctccaggccagctgttgtgctggacagtgggaccacggagrcaaatcaagacacagccctgcatgaggaaggggtagacaaggtccagaggaatccacagaggcgcctggtgctctaatggaggtggcagggggcatggcg

SEQ ID NO: 66131 - DNA, 201 bp, Homo sapiens
gacaggtgtagggcgaggggtgagttcggggcgtggacgtgcgtgggttcacaggtgtgaacggtagccgcacgtgggctgggactgagctgaaaaatcgrccaggggcgaggcccgggtaggaagtgggtgcggcgtggggaggcgtggcctgacggtgtgattggcaggcggagctgatccgagaggacatccaggggg

SEQ ID NO: 66132 - DNA, 201 bp, Homo sapiens
tcccggactatgccatggtagagatcacactcccctaccacccagcaccaccgcctgacctgacctgtcttttttttttttttttttttttttgagatggrgtctcactctgctgccaggctggagtgcagtggcacgatctggactcactgcaacctccgcctcccaggttcaagtgattctcctgcctcagcctcccac

SEQ ID NO: 66133 - DNA, 201 bp, Homo sapiens
gcaaatcaagacacagccctgcatgaggaaggggtagacaaggtccagaggaatccacagaggcgcctggtgctctaatggaggtggcagggggcatggcrggagacccgaggaggcatttagaaggagagagctataatccagactccttccctgcccgcaaggagcctccagtctgtgagaagccagactcaggtgcta

SEQ ID NO: 66134 - DNA, 201 bp, Homo sapiens
tctcgatctcctgacctcgtgatccacccgcctcggcctcccaaagtgctgggattacaggtgtgagccactgcgcccggcctgttttctgttttttgagrtggagcctcgctctcttgcctaggctggagtgcagtggtgcaattatcggctcgccgcaacctctgcctcccgggttcaagtgattttcctgcctcagcc

SEQ ID NO: 66135 - DNA, 201 bp, Homo sapiens
cccagacttctggggctaagggagttgggaatggagacccggattcctgggcctaagggaggaagggggctgggagtgggtaaagtctgagaggttggatycctggatccccaaaaggctggaagaagccagtttgttttcccagggcctgggaagcaccatgcctgggctccctaggaggacagagccctggatattgga

SEQ ID NO: 66136 - DNA, 201 bp, Homo sapiens
agccgcgcctgggaggacccagttgagaaacagctacagcacgagcggaggcgccggcaggtgacccaagcgacacagcagggccgaggctgggaagtccsggggcgcggccggtccgcctggccccgcctgacccgactgtcttacttcctacagcaaagcgccccccaggtcgctgtcaatgggtgagtgtccgcccca

SEQ ID NO: 66137 - DNA, 201 bp, Homo sapiens
cggggctgggaggcagggggcatggtgattggaggagcataaggcgctgggaggtgggtggcatgatgattggaaaataggactaggagagtagggagggrttagaggcgtggcttagttgtgttggggcggggcttaggacagatgccaagattcaattggaggaaaggccaggaattaacgtgaaggaaagatttaaga

SEQ ID NO: 66138 - DNA, 201 bp, Homo sapiens
ctgctgccaggctggagtgcagtggcacgatctggactcactgcaacctccgcctcccaggttcaagtgattctcctgcctcagcctcccacgtagctggsactacaggcgcccgccaccacacccagctaatttttgtatttttagtagagacagggtttcaccatgttggccaagatggtctcaatctcttgactttgt

SEQ ID NO: 66139 - DNA, 201 bp, Homo sapiens
gcggcagcccagactgtttgcggcggcccagactctggcccaagccccgacactcaggaggaagccagagcctctctcctccctgcccagcctggggttasgggcccccactgcagagcagacaggcctgagctccagttcggccctcacactcagtgctgatgtaaccctggtcagaggacatcacctcctggagcctca

SEQ ID NO: 66140 - DNA, 201 bp, Homo sapiens
tgcagcccccatccttcactcaggcagttgcagggcccagaacacccctatcttctaggattgacactggctgtcaaactcatccttcaaggtgattcctrgcctgccctcctcctccaggcagcctgtcctcctcctccaggcagcctgtcctgaccctcagcagcctctcctggccttggcagagcccctcgtgtcctc

SEQ ID NO: 66141 - DNA, 201 bp, Homo sapiens
gggtcagagggaagaggggctgggggcctggactcctgggtcagagggaagaggggctgggggcctggactcctgggtcagagggaagaggggctgggggyctggactcctgggtcagagggaggaggggctggggggctggactcctgggtcagagggaagaggggctgggggcctggactcctgggtttgagggaggag

SEQ ID NO: 66142 - DNA, 201 bp, Homo sapiens
tgcattctagcctgggccacagaactagaccttgtctcaattaagaaaaaaaatggggataataggacccattccataggatgtggtgaggattatgcatmcacacacacacacacacacacacacatttatgatgtactgagaagatataagcacacaataagtatctccaaaattatcaagtggcaaagccaggattca

SEQ ID NO: 66143 - DNA, 201 bp, Homo sapiens
gggcctggactcctgggtcagagggaagaggggctgggggcctggactcctgggtcagagggaagaggggctgggggtctggactcctgggtcagagggargaggggctggggggctggactcctgggtcagagggaagaggggctgggggcctggactcctgggtttgagggaggaggggctgggggcctggactcctgg

SEQ ID NO: 66144 - DNA, 201 bp, Homo sapiens
gggtcagagggaagaggggctgggggcctggactcctgggtcagagggaagaggggctgggggtctggactcctgggtcagagggaggaggggctgggggsctggactcctgggtcagagggaagaggggctgggggcctggactcctgggtttgagggaggaggggctgggggcctggactcctgggtcagagggaagag

SEQ ID NO: 66145 - DNA, 201 bp, Homo sapiens
atgttagccaggatggtctcaatctcctgacctcgtgatccacacgcctcggcctcccaaagtgctgggattacaggcgtgagccaccacacccggccgctttttttttttttaagatggagtctcgctctgtcacccaggctggagtgcagtggcacgatcatctcggttcactgcaacctccacctcccaggttcaagt

SEQ ID NO: 66146 - DNA, 201 bp, Homo sapiens
ggctcactgcaagctccgccttccaggttcacgccattctcctgcctcagcctcccgagtagctgggactacaggtgcccaccaccacgcccggctaattktttgtatttttagtagagacggggtttcaccgtgttagccaggatggtctcgatctcctgacctcgtgatccacccgcctcggcctcccaaagtgctggg

SEQ ID NO: 66147 - DNA, 201 bp, Homo sapiens
tacaggtgcccaccaccacgcccggctaattttttgtatttttagtagagacggggtttcaccgtgttagccaggatggtctcgatctcctgacctcgtgwtccacccgcctcggcctcccaaagtgctgggattacaggtgtgagccactgcgcccggcctgttttctgttttttgagatggagcctcgctctcttgcct

SEQ ID NO: 66148 - DNA, 201 bp, Homo sapiens
aattatcggctcgccgcaacctctgcctcccgggttcaagtgattttcctgcctcagcctcctgagtagctgggattacaggcacccgccaccacacctgkataatttttgtgtttttagtacagatggggtttcaccatgttggctgggctggtctcgaactcctgtcctcaggtgatctgcctgcctcggcctcccaaa

SEQ ID NO: 66149 - DNA, 201 bp, Homo sapiens
ggccccgcgccccggaaccgcagctcagcccgggctcggacgcctccgaggtccgcgcctggctgcaggccaagggctttagctccgggtgagtggggccrgggccctctcggcgcgggttgatacggacgctgggagcggagcgttccgatcggccgggagtcggggggcggcagtcgtggagaccacagggagccggga

SEQ ID NO: 66150 - DNA, 201 bp, Homo sapiens
tcctctgcagccggttcccgcagggcgcacagctgcggggcgcgctgcggacgctgagcctcctggccgcgcagggcctgtgggcgcagacgtccgtgctycaccgagaggatctggaaaggctcggggtgcaggagtccgacctccgtctgttcctggacggagacatcctccgccaggacagagtctccaaaggctgct

SEQ ID NO: 66151 - DNA, 201 bp, Homo sapiens
ggttcccgcagggcgcacagctgcggggcgcgctgcggacgctgagcctcctggccgcgcagggcctgtgggcgcagacgtccgtgcttcaccgagaggayctggaaaggctcggggtgcaggagtccgacctccgtctgttcctggacggagacatcctccgccaggacagagtctccaaaggctgctactccttcatcc

SEQ ID NO: 66152 - DNA, 201 bp, Homo sapiens
aattatccaggcgtggtggcaggcacctgtaatatcagctacttgggaggctgaggcaggagaattacttgaacccaggaggcggaggttgcagtgaaccragatcctgccactggactccagtctgagtgacagagcgagactgcgtctcaaaaaaaaaaaaaaaaaaaaagaaaaagaaaaaaagggccgggcacaatg

SEQ ID NO: 66153 - DNA, 201 bp, Homo sapiens
acttgggaggctgaggcaggagaattacttgaacccaggaggcggaggttgcagtgaaccaagatcctgccactggactccagtctgagtgacagagcgaractgcgtctcaaaaaaaaaaaaaaaaaaaaagaaaaagaaaaaaagggccgggcacaatggctcacgcctgtagtcccagcactttgggggcccaaggtg

SEQ ID NO: 66154 - DNA, 201 bp, Homo sapiens
agcctcccaagtagctgggattacaggcgcctaccaccacgtctggctaatttttgtatttttagtagagacagggtttcaccatgttggccaggctggtytcaaactgctgacctcaaatgaactgtctgcctcagcctcacaaagtactgggattacaggcatgagccacctcacctggtggtgaagactctaaaggct

SEQ ID NO: 66155 - DNA, 201 bp, Homo sapiens
caaatctccttgatgcacaaagtaaccttttcttcccccattgtaccccaggttgaaaatcgatgactttaatgatgaactcaataagctgctggaagaartagaagaaaaaaacccacaactgattattgatactgagaaacatcatccctgggcagaaaggccttcttctcatgacttcatgatctgaatccccccgag

SEQ ID NO: 66156 - DNA, 201 bp, Homo sapiens
tgagaccagcctgaccaacatggtgatgaaacagcatctctactaaaaatacaaaaatttgctggacgtggtggcagacacctgtaatcccagctactccrggaggctgaggcaggagaatcacttaaatctaggaggcgggggttgctatgagccgagatcacgccattgcaccccagcctgggcaacaagagcaaaatt

SEQ ID NO: 66157 - DNA, 201 bp, Homo sapiens
gtgccactccagcctgggcaacagagtgacactctgtctcaaaaaaaaaagatgcaagcattttgaactggaaggagataagagaaaggaacaagtgatcsagttctaagtgtcatcttttcttttatgaaggcaataaaatcttgagcttatggtaaaatgcaaaattttccccccttctcctttttcagaagcagcttt

SEQ ID NO: 66158 - DNA, 201 bp, Homo sapiens
tcagaagcagctttgaaatcctttaataaaaggaagcctctatcattaggtaagttacctcatttataacttttattcttcatgtgagatctggggactcsggcctttgttttaaggagaatgtgctgagcactaagaatgcaaagaaatgccggacttagcatccctgctcccagggcggagctggtctcgcaggtgcgt

SEQ ID NO: 66159 - DNA, 201 bp, Homo sapiens
tttgctgaacagggtgatgttacccaaggccgccctgctggtcaccacgcggcccagggccctgagggacctccggatcctggcggaggagccgatctacrtaagggtggagggcttcctggaggaggacaggagggcctatttcctgagacactttggagacgaggaccaagccatgcgtgcctttgagctaatgaggag

SEQ ID NO: 66160 - DNA, 201 bp, Homo sapiens
gccctgctggtcaccacgcggcccagggccctgagggacctccggatcctggcggaggagccgatctacataagggtggagggcttcctggaggaggacargagggcctatttcctgagacactttggagacgaggaccaagccatgcgtgcctttgagctaatgaggagcaacgcggccctgttccagctgggctcggcc

SEQ ID NO: 66161 - DNA, 201 bp, Homo sapiens
tgaggagcaacgcggccctgttccagctgggctcggcccccgcggtgtgctggatcgtgtgcacgactctgaagctgcagatggagaagggggaggacccrgtccccacctgcctcacccgcacggggctgttcctgcgtttcctctgcagccggttcccgcagggcgcacagctgcggggcgcgctgcggacgctgagcc

SEQ ID NO: 66162 - DNA, 201 bp, Homo sapiens
catgttggtcaggctggtctcaaactcctgacctcaggtgatccgcccgcctcggcctcccaaagtgctgggattacaggcgtgagcaaccgcacccggcyaccttttttttttttttcctttgaggcaagaactcactatgttccccaggctggagtccagcagcacaatgatggctcgctgcaggctcgctccagctcc

SEQ ID NO: 66163 - DNA, 201 bp, Homo sapiens
agatacaagatgctgatcccattcagcaaccccagggtgcttcccgggcccttctcatacacggtggtgctgtatggtcctgcaggccttgggaaaaccaygctggcccagaaactaatgctagactgggcagaggacaacctcatccacaaattcaaatatgcgttctacctcagctgcagggagctcagccgcctgggc

SEQ ID NO: 66164 - DNA, 201 bp, Homo sapiens
gctagactgggcagaggacaacctcatccacaaattcaaatatgcgttctacctcagctgcagggagctcagccgcctgggcccgtgcagttttgcagagytggtcttcagggactggcctgaattgcaggatgacattccacacatcctagcccaagcacggaaaatcttgttcgtgattgacggctttgatgagctggg

SEQ ID NO: 66165 - DNA, 201 bp, Homo sapiens
ccgccaccacgcccggctaattttttgtatttttttagtagagacagggtttcaccgtgttagccaggatggtcttgatctcctgacctcgtgatccaccygcctcagcctcctaaagtgctgggaattacaggcatgagccatcacgccccacctgagactgtcttttaaaaaaaaaaaaaaaaaatcaatgtggaacac

SEQ ID NO: 66166 - DNA, 201 bp, Homo sapiens
tgcctccttaacagactttcaggtacttgggaatttgaaacaaatctccttgatgcacaaagtaaccttttcttcccccattgtaccccaggttgaaaatmgatgactttaatgatgaactcaataagctgctggaagaaatagaagaaaaaaacccacaactgattattgatactgagaaacatcatccctgggcagaaa

SEQ ID NO: 66167 - DNA, 201 bp, Homo sapiens
ctacccacttaaatttaatgacatattcagttcatggctggagacgatgagtagaaggaaaggattcttcccacacccactatatctaggccctgaaacaytaaaaaagaagtcccacaagcagtgagatgtcaccgactcactaactgtatcttcaaatgaatgtctagtttttttggttgtgtgtgtgtgtggtgtgtg

SEQ ID NO: 66168 - DNA, 201 bp, Homo sapiens
ctcatgacttcatgatctgaatccccccgagtcattcattctccatgaagtcatcgattttccaggtgttggtgaactgcctgtgactcctctcctccccsgcccctacccctcagggataatgagttcattgctgggctagatgttttagccatgattctgcctctgttttatacctgcacacatccttatctttgttac

SEQ ID NO: 66169 - DNA, 201 bp, Homo sapiens
gactcctctcctccccggcccctacccctcagggataatgagttcattgctgggctagatgttttagccatgattctgcctctgttttatacctgcacacrtccttatctttgttacatatgaaatatctgtatcacgggtatattgagagaaataaaggtgagagcattcacaaatgaagctgttacttaataatgggct

SEQ ID NO: 66170 - DNA, 201 bp, Homo sapiens
cctcccaaagtgctagaattacaggcatgagccatgtcaccccatgctgtgttttctcttaatctgtgttcttagaactataactgtaacataaattgcaygcaattggttgtaaatggaatcatttacttattttttaatgaatgatttgcaaatcaggtagtcttctgggccagtgtacgctcagactcccaatggaag

SEQ ID NO: 66171 - DNA, 201 bp, Homo sapiens
tgagggacctccggatcctggcggaggagccgatctacataagggtggagggcttcctggaggaggacaggagggcctatttcctgagacactttggagaygaggaccaagccatgcgtgcctttgagctaatgaggagcaacgcggccctgttccagctgggctcggcccccgcggtgtgctggatcgtgtgcacgactc

SEQ ID NO: 66172 - DNA, 201 bp, Homo sapiens
tcataggatcaccagtgcatgatagaaggtggggagttcacaagaaggggcttttggatgctggcacttgtggagctagccgggaaggttgaagttggacmtgtcaaccgtgttgccatttgtgattcttttgtaggttggaaaactgtcaccttacagaagccaattgcaaggaccttgctgctgtgttggttgtcagcc

SEQ ID NO: 66173 - DNA, 201 bp, Homo sapiens
ccgacaatgagcttctggatgagggtgctaagttgctgtacacaactttgagacaccccaagtgctttctgcagaggttgtcgtaagtctctcctctcttmcagagcagctgtgctttcgatctggggccacagacgagcaatggtcatgcctgacttggctgtatggaacctctcgctgatgtgaacacctgttcccatg

SEQ ID NO: 66174 - DNA, 201 bp, Homo sapiens
ctgctgctccagataattcaagtcggggtataacacaaccagtgagatgtaaaccaaagacgattccacggttagattctcaagaatgacttgttctgccrggcgcggtggctcacgcctgtcatcccagcactctgggaggccgaggtgggcagatcacctgagattgggagtttgagaccagcctgaccaacatggaga

SEQ ID NO: 66175 - DNA, 201 bp, Homo sapiens
gtggtgcatggtgcatgcctgcagtcccagctactcgggaggctgaggcaggagaatcacttgaacccaggaggcggaggttgctgtgagccgagattgcrccacctgggcaacaagagtgagactcagtctcaaaaaaaaaaaaaaaaatgacgtggtcctatttctcccacaggttggtgtcttgttccgctaccactc

SEQ ID NO: 66176 - DNA, 201 bp, Homo sapiens
ggagttcacaagaaggggcttttggatgctggcacttgtggagctagccgggaaggttgaagttggacatgtcaaccgtgttgccatttgtgattcttttstaggttggaaaactgtcaccttacagaagccaattgcaaggaccttgctgctgtgttggttgtcagccgggagctgacacacctgtgcttggccaagaac

SEQ ID NO: 66177 - DNA, 201 bp, Homo sapiens
tggtaagacctgggtagatgatggtaggaaaaaagtataagtagtagtagagtagtagtaatattctatagggatttggggaatgtagctggttttcgggtttttttttttcctctttatgtatgtatgtattttagagatgggatctcgccgtgttgcctaggctggtctcaaactcctgagctcaagagatctgcctgc

SEQ ID NO: 66178 - DNA, 201 bp, Homo sapiens
ttgtctctctactaaaaatacaaaaattagtcacgcatggtgggacatgcctgtaatcccagttactcaggaggctaaggcaggagaatcacttgaacttsggaggtggaggttgcagtgagctgagatggcaccactgaagtccagtctggccaatagagcaagactctctcaaaaaaaaaaaattataggacaaatctt

SEQ ID NO: 66179 - DNA, 201 bp, Homo sapiens
aaggcaggagaatcacttgaacttgggaggtggaggttgcagtgagctgagatggcaccactgaagtccagtctggccaatagagcaagactctctcaaamaaaaaaaattataggacaaatctttagaaaggaattggggcctggcatggtggctcatgcctgtaatctcagcactttaggaggcgggcagaacacctga

SEQ ID NO: 66180 - DNA, 201 bp, Homo sapiens
cacggaaaatcttgttcgtgattgacggctttgatgagctgggagccgcacctggggcgctgatcgaggacatctgcggggactgggagaagaagaagccrgtgcccgtcctcctggggagtttgctgaacagggtgatgttacccaaggccgccctgctggtcaccacgcggcccagggccctgagggacctccggatcc

SEQ ID NO: 66181 - DNA, 201 bp, Homo sapiens
atatattgaagacgaagttccgggagatgtggaagagctggcctggagatagcaaagaggtccaggttatggctgagagatacaagatgctgatcccattyagcaaccccagggtgcttcccgggcccttctcatacacggtggtgctgtatggtcctgcaggccttgggaaaaccacgctggcccagaaactaatgctag

SEQ ID NO: 66182 - DNA, 201 bp, Homo sapiens
gcctgtgggcgcagacgtccgtgcttcaccgagaggatctggaaaggctcggggtgcaggagtccgacctccgtctgttcctggacggagacatcctccgmcaggacagagtctccaaaggctgctactccttcatccacctcagcttccagcagtttctcactgccctgttctacaccctggagaaggaggaggaagagg

SEQ ID NO: 66183 - DNA, 201 bp, Homo sapiens
gttcctggacggagacatcctccgccaggacagagtctccaaaggctgctactccttcatccacctcagcttccagcagtttctcactgccctgttctacrccctggagaaggaggaggaagaggatagggacggccacacctgggacattggggacgtacagaagctgctttccggagtagaaagactcaggaaccccga

SEQ ID NO: 66184 - DNA, 201 bp, Homo sapiens
ctccgccaggacagagtctccaaaggctgctactccttcatccacctcagcttccagcagtttctcactgccctgttctacaccctggagaaggaggaggragaggatagggacggccacacctgggacattggggacgtacagaagctgctttccggagtagaaagactcaggaaccccgacctgatccaagcaggctac

SEQ ID NO: 66185 - DNA, 201 bp, Homo sapiens
tccgccaggacagagtctccaaaggctgctactccttcatccacctcagcttccagcagtttctcactgccctgttctacaccctggagaaggaggaggargaggatagggacggccacacctgggacattggggacgtacagaagctgctttccggagtagaaagactcaggaaccccgacctgatccaagcaggctact

SEQ ID NO: 66186 - DNA, 201 bp, Homo sapiens
aggacagagtctccaaaggctgctactccttcatccacctcagcttccagcagtttctcactgccctgttctacaccctggagaaggaggaggaagaggayagggacggccacacctgggacattggggacgtacagaagctgctttccggagtagaaagactcaggaaccccgacctgatccaagcaggctactactcct

SEQ ID NO: 66187 - DNA, 201 bp, Homo sapiens
gccacacctgggacattggggacgtacagaagctgctttccggagtagaaagactcaggaaccccgacctgatccaagcaggctactactcctttggcctygctaacgagaagagagccaaggagttggaggccacttttggctgccggatgtcaccggacatcaaacaggaattgctgcgatgcgacataagttgtaagg

SEQ ID NO: 66188 - DNA, 201 bp, Homo sapiens
ccacacctgggacattggggacgtacagaagctgctttccggagtagaaagactcaggaaccccgacctgatccaagcaggctactactcctttggcctcrctaacgagaagagagccaaggagttggaggccacttttggctgccggatgtcaccggacatcaaacaggaattgctgcgatgcgacataagttgtaaggg

SEQ ID NO: 66189 - DNA, 201 bp, Homo sapiens
aacacaaccagtgagatgtaaaccaaagacgattccacggttagattctcaagaatgacttgttctgccgggcgcggtggctcacgcctgtcatcccagcmctctgggaggccgaggtgggcagatcacctgagattgggagtttgagaccagcctgaccaacatggagagacccccacctctactgaaaatacaaaatta

SEQ ID NO: 66190 - DNA, 201 bp, Homo sapiens
tgggattacagctgtgaaccaccgcacctagcctgtgatcagtttcagatcagccttgcttactccacattccctcttatcttcctggtagcatttttgtyttttcttgagaaagagttttgcccttgtcgcccaggctagagtgcaatggtgtgatctcggctcgccacaacctccacctcccaggttcaagtgattctg

SEQ ID NO: 66191 - DNA, 201 bp, Homo sapiens
cctgagattgggagtttgagaccagcctgaccaacatggagagacccccacctctactgaaaatacaaaattagctgggcatggtggtgcatggtgcatgmctgcagtcccagctactcgggaggctgaggcaggagaatcacttgaacccaggaggcggaggttgctgtgagccgagattgcaccacctgggcaacaaga

SEQ ID NO: 66192 - DNA, 201 bp, Homo sapiens
ccgaggtgggcagatcacctgagattgggagtttgagaccagcctgaccaacatggagagacccccacctctactgaaaatacaaaattagctgggcatgktggtgcatggtgcatgcctgcagtcccagctactcgggaggctgaggcaggagaatcacttgaacccaggaggcggaggttgctgtgagccgagattgca

SEQ ID NO: 66193 - DNA, 201 bp, Homo sapiens
accccccgcccccaaaagacctctcagtaattccggtggatacaggaagtgctcagcaacgattacgccccgagggccaatcacagggctgcggccgagaragaagccttattagagctttctcaacctgcagccctcatctccgccggcgagtagggccaggtgttgggaggtgagtagctctccggcagctctgcaact

SEQ ID NO: 66194 - DNA, 201 bp, Homo sapiens
ttgtatttttttagtagagacagggtttcaccgtgttagccaggatggtcttgatctcctgacctcgtgatccacccgcctcagcctcctaaagtgctggsaattacaggcatgagccatcacgccccacctgagactgtcttttaaaaaaaaaaaaaaaaaatcaatgtggaacactcctttgccacctagaataatcag

SEQ ID NO: 66195 - DNA, 201 bp, Homo sapiens
tgtatctgcactgatggtttctgttcagagattcgattttatgttaacatctctggtattttttttttttttttttaagatggagttttactcttgcccaygctggcaatggcatgatctaggctcactgcaacctccggcttcaaggaggttgattctcctgcctcagcctcctgagtagctgggattacaggcactcac

SEQ ID NO: 66196 - DNA, 201 bp, Homo sapiens
ccccctgtaatcccagctactcggaaggctggggcacaagaatcgcgtgaacccaggaggcggaggttgaagtgagccaccgtgccagctgagaatccttyttacttctccaacttctgttggccacctgcattccttggcttgtggcccttcctccaacttcggcagagcatcttcaaacgttgccctggctcccttatc

SEQ ID NO: 66197 - DNA, 201 bp, Homo sapiens
cacttgagcctgggaggaagaagttacagcgaattgagatcacgtcacctcactccagcctgggtgacagtgagatcctgtctcaaaaaaaaaaaaaaaamaaaaaaaacaaaggcgcctttttaatcactcactgacacgtgtagaggagcaaaaagtttgagttgctggttggcccaggaggtcaaggctgcagtgagc

SEQ ID NO: 66198 - DNA, 201 bp, Homo sapiens
ggttgtcgtaagtctctcctctcttccagagcagctgtgctttcgatctggggccacagacgagcaatggtcatgcctgacttggctgtatggaacctctygctgatgtgaacacctgttcccatgtttagatccaggccgatggcctgtgaattttgttcttctctcattcctattccttcataggatcaccagtgcatg

SEQ ID NO: 66199 - DNA, 201 bp, Homo sapiens
caaaaaaaaaaaaaaaaatgacgtggtcctatttctcccacaggttggtgtcttgttccgctaccactcagcagtgggctgatctctccttggcccttgargtcaaccagtccctgacgtgcgtaaacctctccgacaatgagcttctggatgagggtgctaagttgctgtacacaactttgagacaccccaagtgctttc

SEQ ID NO: 66200 - DNA, 201 bp, Homo sapiens
gttgtctgatggtggtgctaataagtgattacatggtccagctttcaattgtactcatttgtcaggggtatatgcccagagaaaccctaaatacttcagcygtgatggacacacatttggtgtaaccctttcttctcttccctatagatcccaggatgatcagcacatgcttcctttctggacggacctttgttccatatt

SEQ ID NO: 66201 - DNA, 201 bp, Homo sapiens
gtcgaaacctgcagaaaatgtcactgcaggtaataaaggagaatctcccggagaatgtcactgcgtctgaatcagacgccgaggttgagaggtgagaaccrtttcactctaccagtcgttccatctttagcctcatcccatgcccccttaggaagaggccagagcctcctatgcactgtggcttagggtcaggaattccct

SEQ ID NO: 66202 - DNA, 201 bp, Homo sapiens
ccaaaagacctctcagtaattccggtggatacaggaagtgctcagcaacgattacgccccgagggccaatcacagggctgcggccgagaaagaagccttawtagagctttctcaacctgcagccctcatctccgccggcgagtagggccaggtgttgggaggtgagtagctctccggcagctctgcaacttcatttcttta

SEQ ID NO: 66203 - DNA, 201 bp, Homo sapiens
agccagggtgacaaagtgagactccgtctcaaaaaaaaaaaaaaaaaaaatacaaaaagtagctgagcgtggtggtgggtgcccataatcccagctagtcrggaggctgaggcaggagaactgtttgaacctgggaggcagaggttgcagtgagctgagatcgtactactgtactccagcctgggctgcagagtgaaacta

SEQ ID NO: 66204 - DNA, 201 bp, Homo sapiens
ttgtgacagctactgggtggagatggcgagcctccaggtctttgaaaagatgcaccgaatggatctgtctgagagagcaaaggatgaagtcagaggtgagyggaaatcggtccacactgtgtcctaggaggaagcaggcgtcctctccaggactttagaaattcagaaggccaggcgcgctggctcacgcctgtcgtccca

SEQ ID NO: 66205 - DNA, 201 bp, Homo sapiens
ctttatcttctatcagagatcattcactcatggttcatgcttctcctgtatgatgattcagaataccagctattgacatttttcaagcaagaacccttcargaacatcaagttgccccttttctgttagtcctctggtttgagagctctccccttgggaagctgtccagtggctgcccaggcgatgagaacctacatgcat

SEQ ID NO: 66206 - DNA, 201 bp, Homo sapiens
ggttcaagtaattctgctgcctcagcctcccaagttgctgggattacaggcacccgccaccacgcccggctaatttttgtgcatttagtggagctggtttygccacattgccaggctggtctcgaactcatgacctcaggtgacctgccctcctcaggctcccaaagtgctgggattataggcatgagccaccatgcccag

SEQ ID NO: 66207 - DNA, 201 bp, Homo sapiens
cccgagtagctgggactacaggcgcccaccaccacgcctggctaatttttttgtgtttttagtagagacggggtttcaccgtgttagccaggatggtctcratctcctgaccttgtgatccgcccgcctcggcctcccaaagtgctgggattacaggcgtgagccaccgcgcccggcccctgaagattgtgttttgagatg

SEQ ID NO: 66208 - DNA, 201 bp, Homo sapiens
caggcgtgagccaccgcgcccggctgtgtgtttgcattatcatattcagcccagttttcacgaagtttcttgtctcctgggtgatccacgtagctccccasttccttatctgatctatgcttgtcctttcattgttgtgttactactttgctataatgagagagtgttttcgctttataggttaacttttagaacctgagc

SEQ ID NO: 66209 - DNA, 201 bp, Homo sapiens
tgcattatcatattcagcccagttttcacgaagtttcttgtctcctgggtgatccacgtagctccccacttccttatctgatctatgcttgtcctttcatkgttgtgttactactttgctataatgagagagtgttttcgctttataggttaacttttagaacctgagcagcccctcagggaaaaccctgacagtagctgg

SEQ ID NO: 66210 - DNA, 201 bp, Homo sapiens
ggaactggcatttgagacaggagtgctaatcaccatccctctccactcctcccttgattgtcatcacagctcccacgtgggacaagatggtgtcttcggcrcagatgggcttcaacctgcaggctctcctggagcagctcagccaggatgagttgagcaagttcaagtatctgatcacgaccttctccctggcacacgagc

SEQ ID NO: 66211 - DNA, 201 bp, Homo sapiens
ggcgtgagccaccgcacccagccagcaagtgcatttagaactactctactttctaccccataacttttttttttgtttgtttgagacaagtctcactctgycacccaggatggagtgcagcagcacaatctcagcttattgcaactcccgccccctgggttcaagtgtttctcctgcatcagcctcttgaatagctaggat

SEQ ID NO: 66212 - DNA, 201 bp, Homo sapiens
ttcaagaccagcctggccaacatggggaaaccctgtctctactaaaaatacaaaacttagctgggtgtggtggcacgcgcatgtgtgtacacacacacacmcccctgtaatcccagctactcggaaggctggggcacaagaatcgcgtgaacccaggaggcggaggttgaagtgagccaccgtgccagctgagaatccttt

SEQ ID NO: 66213 - DNA, 201 bp, Homo sapiens
  misc_feature (1)...(201): n = A,T,C or G, or insertion/deletion polymorphism (see Tables 1-2)
aaaacttagctgggtgtggtggcacgcgcatgtgtgtacacacacacacccccctgtaatcccagctactcggaaggctggggcacaagaatcgcgtgaanccaggaggcggaggttgaagtgagccaccgtgccagctgagaatcctttttacttctccaacttctgttggccacctgcattccttggcttgtggccctt

SEQ ID NO: 66214 - DNA, 201 bp, Homo sapiens
agtacagtggtgaaatcagctcactgcatcctcaaacttctgggttcaagtgatgttcctgagtacctgggatgacaggtattaagtgtgcaccatcatgyccagctaacttaagtgggggtttttttttgtgtttttttttttttttttttttttggaaagacaaaatctcactatgttgtccaggctggtcttgaactc

SEQ ID NO: 66215 - DNA, 201 bp, Homo sapiens
tgtaacctccacctcccaggttcaagcgattctcctgattctcctgactcagcctcctgagtagctgggattataggcacctgccaccacacccagctaatttttttttttttttttgagacgaagtcttgttcttgtcacccaggctggagtatagtggcaccatccctgttcactgcaacctccgcctcccagattcaa

SEQ ID NO: 66216 - DNA, 201 bp, Homo sapiens
ttttatgaaggcaataaaatcttgagcttatggtaaaatgcaaaattttccccccttctcctttttcagaagcagctttgaaatcctttaataaaaggaarcctctatcattaggtaagttacctcatttataacttttattcttcatgtgagatctggggactcgggcctttgttttaaggagaatgtgctgagcactaa

SEQ ID NO: 66217 - DNA, 201 bp, Homo sapiens
tttctaggctttggaactgcgacataactagcgatggctgctgcgatctcacaaagcttctccaagaaaaatcaagcctgttgtgtttggatctggggctraatcacataggagttaagggaatgaagttcctgtgtgaggctttgaggaaaccactgtgcaacttgagatgtctgtggtgagttaacttataagttcaac

SEQ ID NO: 66218 - DNA, 201 bp, Homo sapiens
tgtgtgccaccacgcccagctaattttttgtattttagtagagacagggtttcaccgtgttagtcaggatggtctggatctcctaacctcgtgatccgtcygcctcagcctcccaaagtgctgggatgacaggcgtgagccactgtgcccagcctagcacacaatcttgacaaagaatttcggtgcgacttggggtactgt

SEQ ID NO: 66219 - DNA, 201 bp, Homo sapiens
cttgctctgtcacccaagctggagtgcagtggcgcaatctcggctcactgcaagctccatctcccgggttcacgccattctgcctcagcctccccagtagytgggactacaggcgcccgccacacgcccggctaattttttgtatttgtagtagagacagggtttcaccgtgttagccaggatggtctcgatctcctgacc

SEQ ID NO: 66220 - DNA, 201 bp, Homo sapiens
caaaggctgctactccttcatccacctcagcttccagcagtttctcactgccctgttctacaccctggagaaggaggaggaagaggatagggacggccacrcctgggacattggggacgtacagaagctgctttccggagtagaaagactcaggaaccccgacctgatccaagcaggctactactcctttggcctcgctaa

SEQ ID NO: 66221 - DNA, 201 bp, Homo sapiens
catctctactaaaaatataaaattaggtgggcgtggtagcgcatacttgtaatcctagctactcaggaggctgaggcaggagaatcacttgaacccgggarggcggaggttgcggggagcctagatcataccattgctctccagcctgcgcagcaagagagaaactgtctcaaaaaataaaataaaataaaattcagtggt

SEQ ID NO: 66222 - DNA, 201 bp, Homo sapiens
gggacggccacacctgggacattggggacgtacagaagctgctttccggagtagaaagactcaggaaccccgacctgatccaagcaggctactactccttyggcctcgctaacgagaagagagccaaggagttggaggccacttttggctgccggatgtcaccggacatcaaacaggaattgctgcgatgcgacataagtt

SEQ ID NO: 66223 - DNA, 201 bp, Homo sapiens
tttttttttttttgagacaaagtctagctctgtttcccaggctggagtacagtggcgctatctcagctcactgcaacttccacctcccaggttcaagcaaytctcgtgcctcagccttctaagtagctgggactacagccgcctgtcaccaacctggctaattttcgtatttttagtcgatatagggtttcactatgttgg

SEQ ID NO: 66224 - DNA, 201 bp, Homo sapiens
ctaatttttgcatttgttagttttatttttagtagacagggtttcaccatgttgggcaggctggtcttgaactcctgacctcaggtgatccacccacttcrgcctcccaaagtgctgggattacaggcatgagccaccgtacctagcccacattgacttttgatacagcaagtatttcttgctatggctctgtataataga

SEQ ID NO: 66225 - DNA, 201 bp, Homo sapiens
cttttggctgccggatgtcaccggacatcaaacaggaattgctgcgatgcgacataagttgtaagggtggacattcaacggtgacagacctgcaggagctsctcggctgtctgtacgagtctcaggaggaggagctggtgaaggaggtgatggctcagttcaaagaaatatccctgcacttaaatgcagtagacgttgtgc

SEQ ID NO: 66226 - DNA, 201 bp, Homo sapiens
ttccacctcccaggttcaagcaattctcgtgcctcagccttctaagtagctgggactacagccgcctgtcaccaacctggctaattttcgtatttttagtygatatagggtttcactatgttggccaggctggtctcaagctccagacctcaggtgatcctcccaccttggactcccaaagtgctgtgattacaggcgtga

SEQ ID NO: 66227 - DNA, 201 bp, Homo sapiens
tgttggccaggctggtctcaagctccagacctcaggtgatcctcccaccttggactcccaaagtgctgtgattacaggcgtgagccaccgcacccggccctgttgttgtttttaaaatagagacagggtcttaagttgccaggctggtctggaacttctggactggagtgatcacccacctgagcttcccaaagtgcgggg

SEQ ID NO: 66228 - DNA, 201 bp, Homo sapiens
taccagtcgttccatctttagcctcatcccatgcccccttaggaagaggccagagcctcctatgcactgtggcttagggtcaggaattccctcttgttggrctctttgtttgtttttgttttgagatggagtcttgctctgtcgctcaggctggagcgcagtggcgcgatcttggctccctgcaacctccgcctcccgggt

SEQ ID NO: 66229 - DNA, 201 bp, Homo sapiens
gttggccaggctggtctcaagctccagacctcaggtgatcctcccaccttggactcccaaagtgctgtgattacaggcgtgagccaccgcacccggccctgttgttgtttttaaaatagagacagggtcttaagttgccaggctggtctggaacttctggactggagtgatcacccacctgagcttcccaaagtgcgggga

SEQ ID NO: 66230 - DNA, 201 bp, Homo sapiens
gtcaggaattccctcttgttggactctttgtttgtttttgttttgagatggagtcttgctctgtcgctcaggctggagcgcagtggcgcgatcttggctcmctgcaacctccgcctcccgggttcaagtgattcttctgcctcagcctcctgagtagctgggactacaggcgcctgccaccttgcccggctaatttttata

SEQ ID NO: 66231 - DNA, 201 bp, Homo sapiens
ttggccaggctggtctcaagctccagacctcaggtgatcctcccaccttggactcccaaagtgctgtgattacaggcgtgagccaccgcacccggccctgttgttgtttttaaaatagagacagggtcttaagttgccaggctggtctggaacttctggactggagtgatcacccacctgagcttcccaaagtgcggggat

SEQ ID NO: 66232 - DNA, 201 bp, Homo sapiens
cagctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagt

SEQ ID NO: 66233 - DNA, 201 bp, Homo sapiens
agctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagtg

SEQ ID NO: 66234 - DNA, 201 bp, Homo sapiens
ctgggcacagtggtgaatgcctgtaatcccagctacttgggaggctgaggcaggagaattgcttgaatccgggaggcagaggttgtagtgagccgagattrcagcactgcactccagccagggtgacaaagtgagactccgtctcaaaaaaaaaaaaaaaaaaaatacaaaaagtagctgagcgtggtggtgggtgcccat

SEQ ID NO: 66235 - DNA, 201 bp, Homo sapiens
tgaatccgggaggcagaggttgtagtgagccgagattgcagcactgcactccagccagggtgacaaagtgagactccgtctcaaaaaaaaaaaaaaaaaawatacaaaaagtagctgagcgtggtggtgggtgcccataatcccagctagtcgggaggctgaggcaggagaactgtttgaacctgggaggcagaggttgca

SEQ ID NO: 66236 - DNA, 201 bp, Homo sapiens
caggcatgattcaccatgcccggcccaaatatatttttttaagacagggtcttgctgtgttgctcaggctggagtacagtggtgaaatcagctcactgcakcctcaaacttctgggttcaagtgatgttcctgagtacctgggatgacaggtattaagtgtgcaccatcatgtccagctaacttaagtgggggtttttttt

SEQ ID NO: 66237 - DNA, 201 bp, Homo sapiens
tcactatgttgcccaggctgggagtttgttcttgaagaagcagggtagatggtgagtgtccttgttcgtggcacagcaggaactggcatttgagacaggastgctaatcaccatccctctccactcctcccttgattgtcatcacagctcccacgtgggacaagatggtgtcttcggcgcagatgggcttcaacctgcagg

SEQ ID NO: 66238 - DNA, 201 bp, Homo sapiens
acttggggtactgtggtgcctgctctatcatcatgcttcagcaggaaatgtgggtgaatagtgcctggtggcatggcaggtaaagaaatgttttgttttgtttttttttttgagacagtcttgctctgtcacccaagctggagtgcagtggcgcaatctcggctcactgcaagctccatctcccgggttcacgccattctg

SEQ ID NO: 66239 - DNA, 201 bp, Homo sapiens
taaacatggaaaaaatagttcctaaagtttaaatatatcgagcccctggtttccatttaagtacgatacaggtgtacacactaaagatttcactttcgttytcttttccctaggttcaaaaacatttccccagctgatgctcatcggaacctctgcctagctcttcgaggtcacaagactgtaacgtatctgacccttcaa

SEQ ID NO: 66240 - DNA, 201 bp, Homo sapiens
tttagtagagacacggttttaccatgttaggttggtcttgaactccttgacctcaggtgatccatccacctcggcctcccaaagtgctgggattacaggcrtgaaccaccgtgcccggcctgagacttctgttggtcatgcagatccccaacacacgagggtgggcttggcttgccggagggcatcgatcagcactggctg

SEQ ID NO: 66241 - DNA, 201 bp, Homo sapiens
agctaccacaagcttatgtggcaattttgtgtaaataagaaaaagttcgttattctgactagaaacagtactaagggcagatgacccaggatgcagcatgrgctgaacttgagtttctacttgccttgaacagtaaacaccctggacaaccatacgtgaggaccctgaatccaaagaaactcccagaatctttatcatctt

SEQ ID NO: 66242 - DNA, 201 bp, Homo sapiens
  misc_feature (1)...(201): n = A,T,C or G, or insertion/deletion polymorphism (see Tables 1-2)
gtggcaattttgtgtaaataagaaaaagttcgttattctgactagaaacagtactaagggcagatgacccaggatgcagcatgggctgaacttgagtttcnacttgccttgaacagtaaacaccctggacaaccatacgtgaggaccctgaatccaaagaaactcccagaatctttatcatctttttttttttttttatga

SEQ ID NO: 66243 - DNA, 201 bp, Homo sapiens
tacttgccttgaacagtaaacaccctggacaaccatacgtgaggaccctgaatccaaagaaactcccagaatctttatcatctttttttttttttttatgragtcttgctctgttgcccaggccaaagtgcaatggcacgatcttggctcactgcaacctctgtctcctgggttcaagtaattctgctgcctcagcctccc

SEQ ID NO: 66244 - DNA, 201 bp, Homo sapiens
ctgcctcagcctcccaagttgctgggattacaggcacccgccaccacgcccggctaatttttgtgcatttagtggagctggtttcgccacattgccaggcyggtctcgaactcatgacctcaggtgacctgccctcctcaggctcccaaagtgctgggattataggcatgagccaccatgcccagccagagtccttatgtt

SEQ ID NO: 66245 - DNA, 201 bp, Homo sapiens
ttttgatttgcatttctctgatggccagtgatgatgagcattttttcatgtgttttttggctgcataaatgtcttcttttgagaagtgtctgttcatgtcsttcgcccactttttgatggggttgtttgtttttttcttgtaaattattttctacctatttctatcgctttcaggtatcgtacagttggcctaacatatct

SEQ ID NO: 66246 - DNA, 201 bp, Homo sapiens
agaataatgggatgcagggtgagggggaatattgggtgaattaaagatttgggtcactaatttctttctttttttctcaagatatagtcttgctctgtctyctaggctggagtgcagtgccacaatcttggttcactgcaacctctgcctcccgggttcaagtgattcttctccgtcaacctcccaagtagctgggattac

SEQ ID NO: 66247 - DNA, 201 bp, Homo sapiens
caagcatgtcccaccatgcctggctgatttttttttttttttttttgtattctaaatagagatggggtttcaccatgttagccaggatagtctcgatgtcrtgacctcatgatctgcccgcctcggcctcccaaagtgttgggattacaggcgtgagccaccgcacccagccagcaagtgcatttagaactactctacttt

SEQ ID NO: 66248 - DNA, 201 bp, Homo sapiens
atatttagtagagccggggtttcaccgtgttggctgggctggtctcgaactcctgacctcaagtgacatccatcttccaaaatgctgggattacagccatrtgccaccacgcccagctaattcttgtatttttaggagaaatggggtttcatcatgttgttccggctggtcttaaactcctggcctcatgatccacctgcc

SEQ ID NO: 66249 - DNA, 201 bp, Homo sapiens
ggccaggagtttgagaccagtcaggccaatgtggtgaaaccctgtctctactaaaaatataaaaaaatcagccgggcgtggtggcacactcctgtagtccyagctacttgggaggctgaggcaggaggattgcttgaaccagagagtcagaggttgcagtgagccaagatcgtgccactgcgctccagcctgggtgacagc

SEQ ID NO: 66250 - DNA, 201 bp, Homo sapiens
aaacatcatccctgggcagaaaggccttcttctcatgacttcatgatctgaatccccccgagtcattcattctccatgaagtcatcgattttccaggtgtkggtgaactgcctgtgactcctctcctccccggcccctacccctcagggataatgagttcattgctgggctagatgttttagccatgattctgcctctgtt

SEQ ID NO: 66251 - DNA, 201 bp, Homo sapiens
tgaggcaggaggattgcttgaaccagagagtcagaggttgcagtgagccaagatcgtgccactgcgctccagcctgggtgacagcaagactccatctcaaraaaaaaaaacaaacaaacatggtattaattacacaatggaatactcctcaaccttaaggaactcctatctttttatttaaaaattgccagttttatttca

SEQ ID NO: 66252 - DNA, 201 bp, Homo sapiens
aaaatcgatgactttaatgatgaactcaataagctgctggaagaaatagaagaaaaaaacccacaactgattattgatactgagaaacatcatccctgggmagaaaggccttcttctcatgacttcatgatctgaatccccccgagtcattcattctccatgaagtcatcgattttccaggtgttggtgaactgcctgtga

SEQ ID NO: 66253 - DNA, 201 bp, Homo sapiens
gttacaagtttgaaaacggcaggaggaaacccagagagttgtaaacttacgaaggtctgggctctgaaaaagatacaaattttctttccatgccaatagcrctcacacagacatggtgaatgttcctgaaacccgccggactttctgtaagaagtgtggcaagcaccacccccacaaagtgacacaaggcaaggattcttg

SEQ ID NO: 66254 - DNA, 201 bp, Homo sapiens
tcctgagtagctgggaccacaggcacttgccaccatgcctggctaatttttttcactttttgtagagacagggtcttgctatgttgcccaggctggcctcraattactaaactcaatcagtcctcctgcctcaccctcccaaactgctggggtacaggtgtgagccatgacacctggcccttaccagctacttatatcctg

SEQ ID NO: 66255 - DNA, 201 bp, Homo sapiens
cctcctgcctcaccctcccaaactgctggggtacaggtgtgagccatgacacctggcccttaccagctacttatatcctgaagattattattatttttttwttttttgagatagagtctctctctgttgcccaggctggagtgcagtggcgtgatctcggctcactgcaagctccgcctcccgggttcatgccattctcct

SEQ ID NO: 66256 - DNA, 201 bp, Homo sapiens
ttcaattgtactcatttgtcaggggtatatgcccagagaaaccctaaatacttcagccgtgatggacacacatttggtgtaaccctttcttctcttccctrtagatcccaggatgatcagcacatgcttcctttctggacggacctttgttccatatttggatcaaataaggatctgatgggtctagcaatcaatgatagc

SEQ ID NO: 66257 - DNA, 201 bp, Homo sapiens
gcgatcttggctccctgcaacctccgcctcccgggttcaagtgattcttctgcctcagcctcctgagtagctgggactacaggcgcctgccaccttgcccrgctaatttttatattttcattagagacgggatctcagcatgttggccagtctggtcttgaactccgcctgacctcaggtgatccacctgcctcagcctcc

SEQ ID NO: 66258 - DNA, 201 bp, Homo sapiens
catggtccagctttcaattgtactcatttgtcaggggtatatgcccagagaaaccctaaatacttcagccgtgatggacacacatttggtgtaaccctttyttctcttccctatagatcccaggatgatcagcacatgcttcctttctggacggacctttgttccatatttggatcaaataaggatctgatgggtctagca

SEQ ID NO: 66259 - DNA, 201 bp, Homo sapiens
tagacgttgtgccatcttcattctgcgtcaagcactgtcgaaacctgcagaaaatgtcactgcaggtaataaaggagaatctcccggagaatgtcactgcktctgaatcagacgccgaggttgagaggtgagaaccgtttcactctaccagtcgttccatctttagcctcatcccatgcccccttaggaagaggccagagc

SEQ ID NO: 66260 - DNA, 201 bp, Homo sapiens
cagtaagacctgggaagctgaaacacgatcgcgtttgttggaaatctataaatacatacaaagcggggaagggtaagcttggcctttgaatctggataagstagagacttttcttttttgagatggaggcttgctctgtcacctaggctgaagtgcagtggtacgacctcggctgactgcaacctctacctcctgggttca

SEQ ID NO: 66261 - DNA, 201 bp, Homo sapiens
cggctaatttttatattttcattagagacgggatctcagcatgttggccagtctggtcttgaactccgcctgacctcaggtgatccacctgcctcagcctccaaagtgggattacaggcatgattcaccatgcccggcccaaatatatttttttaagacagggtcttgctgtgttgctcaggctggagtacagtggtgaaa

SEQ ID NO: 66262 - DNA, 201 bp, Homo sapiens
tggggactcgggcctttgttttaaggagaatgtgctgagcactaagaatgcaaagaaatgccggacttagcatccctgctcccagggcggagctggtctcscaggtgcgtagcagtaagacctgggaagctgaaacacgatcgcgtttgttggaaatctataaatacatacaaagcggggaagggtaagcttggcctttga

SEQ ID NO: 66263 - DNA, 201 bp, Homo sapiens
cccaggctgggagtttgttcttgaagaagcagggtagatggtgagtgtccttgttcgtggcacagcaggaactggcatttgagacaggagtgctaatcacyatccctctccactcctcccttgattgtcatcacagctcccacgtgggacaagatggtgtcttcggcgcagatgggcttcaacctgcaggctctcctggag

SEQ ID NO: 66264 - DNA, 201 bp, Homo sapiens
tttaatgaatgatttgcaaatcaggtagtcttctgggccagtgtacgctcagactcccaatggaagctattggaagctacatgctcaatgtgatcctcctkttaatactaaaatcacaggacacgtggcctggcatagtggctcacgcctataatcccatcaccttgggaggccgaagcaaggcagatcccttgagggcag

SEQ ID NO: 66265 - DNA, 201 bp, Homo sapiens
gggctgaacttgagtttctacttgccttgaacagtaaacaccctggacaaccatacgtgaggaccctgaatccaaagaaactcccagaatctttatcatctttttttttttttttatgaagtcttgctctgttgcccaggccaaagtgcaatggcacgatcttggctcactgcaacctctgtctcctgggttcaagtaatt

SEQ ID NO: 66266 - DNA, 201 bp, Homo sapiens
aggttgaagtgagccaccgtgccagctgagaatcctttttacttctccaacttctgttggccacctgcattccttggcttgtggcccttcctccaacttcrgcagagcatcttcaaacgttgccctggctcccttatcacgtcacctcctgctggctttgactctcagctccctcttatgaggatccctgtgattgctgga

SEQ ID NO: 66267 - DNA, 201 bp, Homo sapiens
tcctgacctcaggtgatccgcccatctcggcctcccaaagtgctgggattacaggcgtgagccactgcgccaggccctatgtctaagttctagtctgtgtyatgcaaagaacacctgtgaaattttaaggatacagtgcctcaagccattcagccaaaagccactgcccagcaccccacattcagagaggtgggaattggg

SEQ ID NO: 66268 - DNA, 201 bp, Homo sapiens
ccgggttcatgccattctcctgcctcagcctcccgagtagctgggactacaggcgcccaccaccacgcctggctaatttttttgtgtttttagtagagackgggtttcaccgtgttagccaggatggtctcgatctcctgaccttgtgatccgcccgcctcggcctcccaaagtgctgggattacaggcgtgagccaccgc

SEQ ID NO: 66269 - DNA, 201 bp, Homo sapiens
tggcctcatgatccacctgccttggcctgccaaagtcctgggattacaggcatgagccactgtgcccagccactcatttcttatgaatttattctaacacrttttccggatgaacagggcaccttgaaacataggttagtgggctgggtatggtggcttctgcctgtaatcccagtactttgggaggcctaggctggtgta

SEQ ID NO: 66270 - DNA, 201 bp, Homo sapiens
cctcaagccattcagccaaaagccactgcccagcaccccacattcagagaggtgggaattgggccaggcacagtggctcatacctgtaatcccagcacttygggaggccgaagcgggcggatcacttaaggtcaggagctcaagaccagcctggccaacttgaaactccatctctactaaaatataaaaattagccgagca

SEQ ID NO: 66271 - DNA, 201 bp, Homo sapiens
tccctccccagcatcttttcaggagttccatggactcacctcttcattatccagggttaagctgcagatattgttattaggattccaccttgttctctctytttttttttttttttttttttgatacggagtctcgcttgctcttttgccaggctgaagtgcagtggagcgatcttggctcactgcaatctccgcctcctg

SEQ ID NO: 66272 - DNA, 201 bp, Homo sapiens
tgggaggccgaagcgggcggatcacttaaggtcaggagctcaagaccagcctggccaacttgaaactccatctctactaaaatataaaaattagccgagcrtagtagtgggtgcctctttttttttttttttttttttgagatagtttcactcttgttgcccaggctgtagtgtaatggcgcgatctcagctcactgcaac

SEQ ID NO: 66273 - DNA, 201 bp, Homo sapiens
tccccagcatcttttcaggagttccatggactcacctcttcattatccagggttaagctgcagatattgttattaggattccaccttgttctctctttttytttttttttttttttttgatacggagtctcgcttgctcttttgccaggctgaagtgcagtggagcgatcttggctcactgcaatctccgcctcctgggtt

SEQ ID NO: 66274 - DNA, 201 bp, Homo sapiens
tctcaggaaaaaataaaaaagaggtaggaattagatatcgtgccagaaaatgctggctctatcagcaggtgagtggtctcaacttggctatcttacaaatmccttgtgagttagctacaatcagatgcacttgaacctggaatcctatctgggaggcaatcttaaaagaatttgactcgggatgggcaaggtggctcatgc

SEQ ID NO: 66275 - DNA, 201 bp, Homo sapiens
ctggcaggcagatcacctgaggttgggagttcgagaccagcctgaccaacgtagagaaaccctgtctgtactaaaaatacaaaattagccaggtatggtgrcacattcctgtaatcccagctactccggaggccgaggcaggagaatcacttgaacccaggaggcggaggttgcagtgagccgacatcacaccattgcatt

SEQ ID NO: 66276 - DNA, 201 bp, Homo sapiens
taccttgtgagttagctacaatcagatgcacttgaacctggaatcctatctgggaggcaatcttaaaagaatttgactcgggatgggcaaggtggctcatrcctgtaatcctggcattttgggagtccaaggcaggtagattgcttgaggccaagaatttaaaaacagcctggccaacacaatgaagccctgtctctactg

SEQ ID NO: 66277 - DNA, 201 bp, Homo sapiens
tagctgggactacaggcgtccgccaccacgcccggctaattttttgtatttttttagtagagacagggtttcaccgtgttagccaggatggtcttgatctsctgacctcgtgatccacccgcctcagcctcctaaagtgctgggaattacaggcatgagccatcacgccccacctgagactgtcttttaaaaaaaaaaaaa

SEQ ID NO: 66278 - DNA, 201 bp, Homo sapiens
cctttcttctcttccctatagatcccaggatgatcagcacatgcttcctttctggacggacctttgttccatatttggatcaaataaggatctgatgggtytagcaatcaatgatagctttctcagtgcctccctagtaaggatcctgtgtgaacaaatagcctctgacacctgtcatctccagagagtggtgtaagtaga

SEQ ID NO: 66279 - DNA, 201 bp, Homo sapiens
cagcctgggcaacagagtgacactctgtctcaaaaaaaaaagatgcaagcattttgaactggaaggagataagagaaaggaacaagtgatccagttctaartgtcatcttttcttttatgaaggcaataaaatcttgagcttatggtaaaatgcaaaattttccccccttctcctttttcagaagcagctttgaaatcctt

SEQ ID NO: 66280 - DNA, 201 bp, Homo sapiens
tgccggagggcatcgatcagcactggctgcattaacgtgttgatttctgtgtttccccaggttgtggggatgttccatccctccgttcagttgtgaagacstctgctctgccctcagctgcaaccagagcctcgtcactctggacctgggtcagaatcccttggggtctagtggagtgaagatgctgtttgaaaccttgac

SEQ ID NO: 66281 - DNA, 201 bp, Homo sapiens
tcactccagcctgggtgacagtgagatcctgtctcaaaaaaaaaaaaaaaacaaaaaaaacaaaggcgcctttttaatcactcactgacacgtgtagaggmgcaaaaagtttgagttgctggttggcccaggaggtcaaggctgcagtgagccaagatggcgttaccacactccagcctgggcaaccgagtgagaccgtgt

SEQ ID NO: 66282 - DNA, 201 bp, Homo sapiens
tgaaacaaatctccttgatgcacaaagtaaccttttcttcccccattgtaccccaggttgaaaatcgatgactttaatgatgaactcaataagctgctggwagaaatagaagaaaaaaacccacaactgattattgatactgagaaacatcatccctgggcagaaaggccttcttctcatgacttcatgatctgaatcccc

SEQ ID NO: 66283 - DNA, 201 bp, Homo sapiens
aatcagtcctcctgcctcaccctcccaaactgctggggtacaggtgtgagccatgacacctggcccttaccagctacttatatcctgaagattattattattttttttttttttgagatagagtctctctctgttgcccaggctggagtgcagtggcgtgatctcggctcactgcaagctccgcctcccgggttcatgcca

SEQ ID NO: 66284 - DNA, 201 bp, Homo sapiens
gaggcaggtggatcacctaaggtcaggagttcgtagaccagcctgtctctactaaagagacaggtgaaaccctgtctctctaaaaccacaaaaatcaggcrggcatggtggcacatagctataatctcatctacttggaggcacgagaactgcttgaatccaggaggcagaggctacagtgagccgagatcatgccacagc

SEQ ID NO: 66285 - DNA, 201 bp, Homo sapiens
cgcgatctcggctcactgcaacctccgcctcctgggttcaagcgattctcctgccccagcctcctgagtagctgggattacaggtgcctgtcaccacgccyagctaacttctgtatatttagtagagacacggttttaccatgttaggttggtcttgaactccttgacctcaggtgatccatccacctcggcctcccaaag

SEQ ID NO: 66286 - DNA, 201 bp, Homo sapiens
gggtgaggcagagaattgcttgaacctgggaggcggaagttgcagtgagctgagattgtgccactgtactccagcctgggtgtcagagcgagactgtctcaaaaaaaaaaaaaaaaaagtttctatacattcataaagtttcaagatttgggggtgtgttttcacttctccatcgtcatggactccaatctgccatctatt

SEQ ID NO: 66287 - DNA, 201 bp, Homo sapiens
agcgattctcctgccccagcctcctgagtagctgggattacaggtgcctgtcaccacgcccagctaacttctgtatatttagtagagacacggttttaccrtgttaggttggtcttgaactccttgacctcaggtgatccatccacctcggcctcccaaagtgctgggattacaggcgtgaaccaccgtgcccggcctgag

SEQ ID NO: 66288 - DNA, 201 bp, Homo sapiens
attttgtattttaatagagatggggtttcactatgttggccaggctggtcttgaactcctgaccacgtgatcaacccgcctcagcctcccaatgtgctggrattacaggtgtgagccgccatgcccagctacacttttttttgaaacggggtctcgttttcttgctcaggctggagtacaatggggcaatcacagctcact

SEQ ID NO: 66289 - DNA, 201 bp, Homo sapiens
tgggacttggacatctttaggggaggccattcttctgtccaccacaccaccccatgattccatttccatgtcaccactgtctctaagtgtgtctaacccayggctcaagagtcaaaggtgcatcacagcagtgagaactcacaggttcgggtttgctttcttcctgtggttgatttctaggctttggaactgcgacataac

SEQ ID NO: 66290 - DNA, 201 bp, Homo sapiens
ctatctcctgttcctttgaagaaccccatctctctccaatcttttcctccactattcttaatgtgcccactgtctcctggagaatgccaacctcccttccrtaagaatagagggaagaacgaacgttgcagagaattagaactcagtttgtagaaagttaggagcacagcgcagagagtttttgtttttgtttttgttttg

SEQ ID NO: 66291 - DNA, 201 bp, Homo sapiens
attgcaggatgacattccacacatcctagcccaagcacggaaaatcttgttcgtgattgacggctttgatgagctgggagccgcacctggggcgctgatcsaggacatctgcggggactgggagaagaagaagccggtgcccgtcctcctggggagtttgctgaacagggtgatgttacccaaggccgccctgctggtcac

SEQ ID NO: 66292 - DNA, 201 bp, Homo sapiens
gctgaggtgggaggatcacttgagcctgggaggaagaagttacagcgaattgagatcacgtcacctcactccagcctgggtgacagtgagatcctgtctcaaaaaaaaaaaaaaaacaaaaaaaacaaaggcgcctttttaatcactcactgacacgtgtagaggagcaaaaagtttgagttgctggttggcccaggaggt

SEQ ID NO: 66293 - DNA, 201 bp, Homo sapiens; identical to SEQ ID NO: 36531

SEQ ID NO: 66294 - DNA, 201 bp, Homo sapiens; identical to SEQ ID NO: 36599

SEQ ID NO: 66295 - DNA, 201 bp, Homo sapiens; identical to SEQ ID NO: 36694

SEQ ID NO: 66296 - DNA, 201 bp, Homo sapiens; identical to SEQ ID NO: 36695

SEQ ID NO: 66297 - DNA, 201 bp, Homo sapiens
cccgccgggccctcccggggagcgcgcccgccctcgccgccgcggctcccgccccccgcgcagccgtcgcgctccatcgtggccccggccgctccggcccsgctgcccggccgcgcctttaataggccccgcgccgcccgccccgccccgcccctccccgccgcgcccgcccctcgcggtcagatccttggctccccgccc

SEQ ID NO: 66298 - DNA, 201 bp, Homo sapiens
attgatttaattatttattaatgggtcatggtatctggcatttgagagatagctttaatctaaaggagtaaataccttgagaattttcagcagaaatttargcctttgcctttactcctgtctccaatttttgagaaaagaaaggtgtttttttggttgctgtttgttttattttgctgatgtgaaataggaaggattttt

SEQ ID NO: 66299 - DNA, 201 bp, Homo sapiens
cctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcactctgttgtccaa

SEQ ID NO: 66300 - DNA, 201 bp, Homo sapiens
tcctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcactctgttgtcca

SEQ ID NO: 66301 - DNA, 201 bp, Homo sapiens
gtcctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcactctgttgtcc

SEQ ID NO: 66302 - DNA, 201 bp, Homo sapiens
acaaacaaacactaaagttgcatatagtttatggagttattcacatttattttagttgataaaattatacagtcatgtgttgcttaatgacaggtacattytgagaaatttgtcattaggtgatttcatcattgtgggaacatcatagagtgtacttgcacaaatttagatgatactgcacatggtgtaacttattactcc

SEQ ID NO: 66303 - DNA, 201 bp, Homo sapiens
aactggagggcaagaagtggagagtggtgagttaaaaatacctagacaggggcaggtatttttattattttatttttttgagatggagtttcactttgtcrcccaggctggagtgcagtggcgcgatttcggcttaccgcaacctccgcctcccggggaaaaggagtaggaacaggaggttaaatggagcttagctagatg

SEQ ID NO: 66304 - DNA, 201 bp, Homo sapiens
tgttggccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatctt

SEQ ID NO: 66305 - DNA, 201 bp, Homo sapiens
ggtcctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcactctgttgtc

SEQ ID NO: 66306 - DNA, 201 bp, Homo sapiens
gacagggttttgccatgttggccaggctggtctcgaactcctcaagggaaccacccacctcagcctctcaaagtgctgggattacaggcatgagccaccaygcgctcggccaaatgtttgatttttttcagagacagggtcttgctatgttgcctgggctggtcttaaacccctggcctcaggtgattctctggcctcagt

SEQ ID NO: 66307 - DNA, 201 bp, Homo sapiens
gatccgcctgcctcggcctcccaaagtgctgggattacaggcgtgagccaccgcgcccagcctgtttttttttgttttgttttgttttttaaataaaagcmgaaaaactttaacaaatataatctacagtatttattccattcacattttattttgttgtcttaaccaatatgagtgcttctggaggggagggaccatgtg

SEQ ID NO: 66308 - DNA, 201 bp, Homo sapiens
ctcaagtaatcttctcgcttcagcctcctgagtagctgggactacagttctttttctttcttttgttttttgtttttttgagatggagttttgctcggtcrcccaggctggagtgcagtggcgtgatcttggctcactgcaacctccccctcccgggttcaagcagttctcctgcctcagcctcctgagtagctgggacta

SEQ ID NO: 66309 - DNA, 201 bp, Homo sapiens
ctacaatgaatgaatcatttgtttctgttgaagcttcaagaaattactgttccttcaaggaatttctgggtgggcaggttggagtacaatggtgcaatcayggctgattgcaacctccaacttttgggctcaagtaatcttctcgcttcagcctcctgagtagctgggactacagttctttttctttcttttgttttttgt

SEQ ID NO: 66310 - DNA, 201 bp, Homo sapiens
ctatgattgtacaatgtccccaactaaattctgtgagggcaggccccatagccatacttagcacagtcgatggtacatgataagcactcagtatcctacartgaatgaatcatttgtttctgttgaagcttcaagaaattactgttccttcaaggaatttctgggtgggcaggttggagtacaatggtgcaatcatggctg

SEQ ID NO: 66311 - DNA, 201 bp, Homo sapiens
cctggaggacaaaattgcccctggttgagaattgctgcgttagaaagtatcgtagctatgattgtacaatgtccccaactaaattctgtgagggcaggccycatagccatacttagcacagtcgatggtacatgataagcactcagtatcctacaatgaatgaatcatttgtttctgttgaagcttcaagaaattactgtt

SEQ ID NO: 66312 - DNA, 201 bp, Homo sapiens
gagtgcagtggcacaatctcggctcactgcaagctcagcctcccgggttcacgccattcacctgcttcagcctcccgagtagctgggactacaggcgccckccaccaggcccagctaattttttgtatttttagtatagacggggtttcactgtggtcttgatctcctgatctcgtgatctgctcgcctcggcctcccaag

SEQ ID NO: 66313 - DNA, 201 bp, Homo sapiens
ctgtcacccaggctggagtgcagtggcacaatctcggctcactgcaagctcagcctcccgggttcacgccattcacctgcttcagcctcccgagtagctgrgactacaggcgcccgccaccaggcccagctaattttttgtatttttagtatagacggggtttcactgtggtcttgatctcctgatctcgtgatctgctcg

SEQ ID NO: 66314 - DNA, 201 bp, Homo sapiens
catcagaactgtgtcagttgaagctctttgtggggctctctcttcaagagaaaatccgggggcatatcagcacatttatcatttaccagacttttatttawtttatttatttgtatttttagtagagatggggtttcgccgtgaaggccaggctgctctcgaactcctaacctcaggtgatccccccacctcggcctccca

SEQ ID NO: 66315 - DNA, 201 bp, Homo sapiens
cactgtggatgggctttagtagtgctcctgtggagatcttaaaactcctacagtattgcttctctcctcatccttcactggttgggagactctctctttamttttactcccacctcaaaattttatggtgcaagatgtgaaaagttgaattagagaaaatttagatttctcttggagtcaaagaatataggtttccttctt

SEQ ID NO: 66316 - DNA, 201 bp, Homo sapiens
cagcctcccaaagcgctgggattacaggcatgagccattgcacctggccttacaggcatgagccattgcacctggcctaaatggcatctttactggggcamagtggtgcctgttatttggtttctgtgttaaacaagccaacttgtatcttctggtagcatgtgtaggttttactttgtgacatgttaaaacctcgtgata

SEQ ID NO: 66317 - DNA, 201 bp, Homo sapiens
cccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaacct

SEQ ID NO: 66318 - DNA, 201 bp, Homo sapiens
ccatcctcccacctcagtctcccaggtagctgggaccacagctgtacaccaccatgcttggaaaaattttaaattatttttgtagagacaaggtctccctrtgttgccccggctagtcttgaactcctgacctcaagcaaccctcctgtcttggcctcccaaagtgctgggattagaggagtgagccactgtgcccagcca

SEQ ID NO: 66319 - DNA, 201 bp, Homo sapiens
tgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaac

SEQ ID NO: 66320 - DNA, 201 bp, Homo sapiens
gcaaccctcctgtcttggcctcccaaagtgctgggattagaggagtgagccactgtgcccagccagtatcctaactcttatcagtcaggatggaggcaagrggcatctattcatgagatacactaaatagagcctatggattttgatgactgataagatgttgtgggggagtttatggaatccttactattttccaggact

SEQ ID NO: 66321 - DNA, 201 bp, Homo sapiens
actgaagccctttggatttttgtgctattattgtcttcattataaagataaggaaattgagtctcagaaagtttgataactgcttatagtcacaaagccastgcatattgttattcaaacctccaatctctctgatttctctaaagaacactcttatccactatataatactgcccaacagtttccagttactgacttgat

SEQ ID NO: 66322 - DNA, 201 bp, Homo sapiens
ttatggtggtaccacctcgcaaataggctgggtgttactacaacaagggtagtcagaggctttaggagtgtacatgaccaccggaagaatgtacgtgtgtrtagagaataagaaaaggtgtgtctttcacacaactgaatctcattctctacacacacatacaatgtcatacttaaattctggacattattttccataaca

SEQ ID NO: 66323 - DNA, 201 bp, Homo sapiens
ttctcattctcattttttttctttgcttctcttttaaacaacactctctgacaagtgattgggcccacagagaccagagcctgtacacagagaatggacaragactatattgtcttccttactttatcttgtgagctgcttatctcttccgcagggaggacaatgtgttaaattgagataattctggcatgctgtcatctt

SEQ ID NO: 66324 - DNA, 201 bp, Homo sapiens
ctgaatggttaagatctgagaattgagatgttcaggaaatggagctttggaggaagggtgcaaacacaaacaaagttcatccattttgccaaggtgcctayttgaatgctaagcccctaattgttttttattttatttatgtttaaaaaaaaatttttttttttagacagggtgttgttttgtcacccagactggagggta

SEQ ID NO: 66325 - DNA, 201 bp, Homo sapiens
tttgaaatgcctagggagtttttaaaagaaaggcgggcacatccttgtatttacaggcagatatcctccctttcctcctcggctgctgctcttactttgamaagccaggctaacattgaaggtatgtacttctggacctgaaatcagacggctcaggtttggtctggcctcagtgctaagtgtctgtggccataggtgcct

SEQ ID NO: 66326 - DNA, 201 bp, Homo sapiens
aattagattttaattcttaatctgtcctgaatggttaagatctgagaattgagatgttcaggaaatggagctttggaggaagggtgcaaacacaaacaaarttcatccattttgccaaggtgcctatttgaatgctaagcccctaattgttttttattttatttatgtttaaaaaaaaatttttttttttagacagggtgt

SEQ ID NO: 66327 - DNA, 201 bp, Homo sapiens
aaatgcctagggagtttttaaaagaaaggcgggcacatccttgtatttacaggcagatatcctccctttcctcctcggctgctgctcttactttgacaagscaggctaacattgaaggtatgtacttctggacctgaaatcagacggctcaggtttggtctggcctcagtgctaagtgtctgtggccataggtgccttaaa

SEQ ID NO: 66328 - DNA, 201 bp, Homo sapiens
ccggatcaggtcctcctccccctccaccaggcccccctcctcccccagtctctaccagttcaggctcagatgagtctgcttcccgctcagcactgttcgcrcagattaatcagggggagagcattacacatggtgagtgagcacttggacacgaacagtaggtacaacaagttgtgtgggccagaccccaccaaccagaac

SEQ ID NO: 66329 - DNA, 201 bp, Homo sapiens
aaaagaaaggcgggcacatccttgtatttacaggcagatatcctccctttcctcctcggctgctgctcttactttgacaagccaggctaacattgaaggtrtgtacttctggacctgaaatcagacggctcaggtttggtctggcctcagtgctaagtgtctgtggccataggtgccttaaacttctttcagcctcctttt

SEQ ID NO: 66330 - DNA, 201 bp, Homo sapiens
gcctcctgagtagctgggactataggcccctgccaccgtgcctggctaattttttttattagagacggggtttcacagtgttagctaggatggtctcgatytcctgaccttgtgatccgcctgcctcggcctcccaaagtgctgggattacaggcgtgagccaccgcgcccagcctgtttttttttgttttgttttgtttt

SEQ ID NO: 66331 - DNA, 201 bp, Homo sapiens
accgcaagctccgcctcccgggttcatgccattctcctgcctcagcctcctgagtagctgggactataggcccctgccaccgtgcctggctaattttttttattagagacggggtttcacagtgttagctaggatggtctcgatctcctgaccttgtgatccgcctgcctcggcctcccaaagtgctgggattacaggcgt

SEQ ID NO: 66332 - DNA, 201 bp, Homo sapiens
ctggtcaatagagccagaccctgttttttgtttgtttggggtttttttgttttgtttttttgttttttgagatggagtctcactctgtcgcccaggctggmgtgcagtggcgcgatcttggctcaccgcaagctccgcctcccgggttcatgccattctcctgcctcagcctcctgagtagctgggactataggcccctgc

SEQ ID NO: 66333 - DNA, 201 bp, Homo sapiens
cacactgaacttagaaccagaaggatcagataaggatatgatggagtactggcttctctattcactggccgtgtgactagacaagtcatttagcttcactraaactaagttttctatctctaagcgtgtagtaatcatccttctattcctgaatagttgtcgggaggctcaaactgagataatgtatgtgactatcctttg

SEQ ID NO: 66334 - DNA, 201 bp, Homo sapiens
gaggctgaagccaggaggtcaaggctgcagtgagctgtgaacacaccattgccctccagcctggtcaatagagccagaccctgttttttgtttgtttgggktttttttgttttgtttttttgttttttgagatggagtctcactctgtcgcccaggctggagtgcagtggcgcgatcttggctcaccgcaagctccgcctc

SEQ ID NO: 66335 - DNA, 201 bp, Homo sapiens
actccagcctgggcaacagagtgagactccatctcaaaaaattacagtaataataaataaatacaaatatcttttgtagtagcattattttagatgaatarcagcttttaacctaactttctagaccctaatatcatcacttgtctccacatcccattctgtttatcagacagtacttgtaagctctttgctttcatcata

SEQ ID NO: 66336 - DNA, 201 bp, Homo sapiens
gcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaacc

SEQ ID NO: 66337 - DNA, 201 bp, Homo sapiens
agcggctgatcgcagtccggaggtgaggcggaactctgaggtgagggtgtgcagcttggtagggattggggtcccttccggggcccatcggcccctggtgktgttaatggcccttctggcctacgcgcgtgtcatgaaccctgccgagagggccggggctgaggccctcaggccgacccggactcttgggcgcggtctctt

SEQ ID NO: 66338 - DNA, 201 bp, Homo sapiens
tcctcttgatgaaatgttttttatttttttattttttttgagacggagttttgctcgtttcccagcctggagtgcaatggcgcgatctcggctcaccgcarcctccacctcccaggttcaagcaattctcctgcctcagcctcccgagtacctgggattacagccatgcgtcaccatgcctggctaattttttttttttgt

SEQ ID NO: 66339 - DNA, 201 bp, Homo sapiens
ctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaa

SEQ ID NO: 66340 - DNA, 201 bp, Homo sapiens
atgtcctcttgatgaaatgttttttatttttttattttttttgagacggagttttgctcgtttcccagcctggagtgcaatggcgcgatctcggctcaccrcaacctccacctcccaggttcaagcaattctcctgcctcagcctcccgagtacctgggattacagccatgcgtcaccatgcctggctaattttttttttt

SEQ ID NO: 66341 - DNA, 201 bp, Homo sapiens
tctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaa

SEQ ID NO: 66342 - DNA, 201 bp, Homo sapiens
agatacccttaacacagctggtggaagtctgagttgtccagccacttctaggaatctatgatcatagtagctaaaaatggtgtaacaacctaaatccaacwgtaagagaaatggctaactaccacatgtcctcttgatgaaatgttttttatttttttattttttttgagacggagttttgctcgtttcccagcctggagt

SEQ ID NO: 66343 - DNA, 201 bp, Homo sapiens
tgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgtt

SEQ ID NO: 66344 - DNA, 201 bp, Homo sapiens
ggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatg

SEQ ID NO: 66345 - DNA, 201 bp, Homo sapiens
ctaaatggcatctttactggggcaaagtggtgcctgttatttggtttctgtgttaaacaagccaacttgtatcttctggtagcatgtgtaggttttacttygtgacatgttaaaacctcgtgataagaattcattagaagtagaactaactactacatagtttagtggtaatttagaagggatagtcaagtagagattttt

SEQ ID NO: 66346 - DNA, 201 bp, Homo sapiens
ctaaacctcgggtggcagtgactcaggcactaaatgtcattggtttaatcagtgaaaccaaatgcttagagaagaacagtggctcctgatttgggttagayttagatggcatcttttttttttttttgagatggtgtcttgctctgtcttggctcaccgtaacctccgcctcccgggttcaagcagttctcctgcctcagc

SEQ ID NO: 66347 - DNA, 201 bp, Homo sapiens
ttaaagcaactattcaggctgaaatcagccaatgcagttttcccttacacgctataaaacatgtagaagtagaaagggactgccgagtgctctgtgcaatkagtcttcataatattctttgaacgtaggagagaagagaacccatgaccacacaaagttacctgtttgctccagacattgaaacagctagttcccaagtct

SEQ ID NO: 66348 - DNA, 201 bp, Homo sapiens
acgtcatccttgaatccatctttatatattagagtgggaaatgctgttttattaaagcaactattcaggctgaaatcagccaatgcagttttcccttacaygctataaaacatgtagaagtagaaagggactgccgagtgctctgtgcaattagtcttcataatattctttgaacgtaggagagaagagaacccatgacca

SEQ ID NO: 66349 - DNA, 201 bp, Homo sapiens
ctggagtgcagtggcacgatcttggctcactgcaacccccgcctcctgggttcaagcaattcttctgcctcagcctcctgagtagctggtactacaggtgygcaccaccacgcccagctaatttttgtatttttagtagagatggggtttaactatattggccaggctggtctcaaactcctgaccttgtgttctgctagc

SEQ ID NO: 66350 - DNA, 201 bp, Homo sapiens
gctccaccatgcctggctaattttctaattttttcgtagagatgaggtctcactgtttcccaggctggtctctaatgattctcctgccttggtctccccaragtgctgggattacaggtgtgagccactgtgcccagccaagttcagctttttctcaaggggtaaaggataaacccatttggttacttgctggagtagcac

SEQ ID NO: 66351 - DNA, 201 bp, Homo sapiens
taccatgctggccaggctggtctcgaactcctgacctcgtgatccgcctgcctcgccctcccaaagtgttgtgattacaggtgtgagcctccgcacccggygtgaagggcttttaatgccttgttgaatttgtttggatttgattttgtgggtggcagtttgctaattgatttgcccaggtccagcataaagaaatttctg

SEQ ID NO: 66352 - DNA, 201 bp, Homo sapiens
ccatttctaattttttttttttttttttttttttttgagacagagtgtctctctgtcgcccaggctggagtgcagtggcgcgatctcggctcactgcaaayctccgcctcctggattcaagagattcttgtgcctcagttctggcagaaggtggtgtttttacaagatgatttctaggattacaggcatgcaccaccatgc

SEQ ID NO: 66353 - DNA, 201 bp, Homo sapiens
gaaactgggattacaggcgtgcgccaccacgcccggctaatttttgtatttttagtagagacgggattttaccatgctggccaggctggtctcgaactcctgacctcgtgatccgcctgcctcgccctcccaaagtgttgtgattacaggtgtgagcctccgcacccggcgtgaagggcttttaatgccttgttgaatttg

SEQ ID NO: 66354 - DNA, 201 bp, Homo sapiens
gcctcctggattcaagagattcttgtgcctcagttctggcagaaggtggtgtttttacaagatgatttctaggattacaggcatgcaccaccatgcctggytaatttttgtatttttagtagagacgaggtttcgccattttagccaggctggtctcgaactcttgacctcaggttatctacccgcctcagcctccctaag

SEQ ID NO: 66355 - DNA, 201 bp, Homo sapiens
ggcatgcaccaccatgcctggttaatttttgtatttttagtagagacgaggtttcgccattttagccaggctggtctcgaactcttgacctcaggttatcyacccgcctcagcctccctaagtgctgagattacaggcctgagccactgcgccaggcctggttttttggtttcaaaccacaatagacattgctggagaatc

SEQ ID NO: 66356 - DNA, 201 bp, Homo sapiens
ctctgcatgatatccctccaaaagcttgtctattctcatgacttcatgacagttctttgccaatgatttgcaaacattatctccagtcttgattctttccyaggctttatttctaaatactcactagtcatttccacttagaagctttgtcttcttttcaaactcagcatatccaaaactgacctcatcttgttgccctaa

SEQ ID NO: 66357 - DNA, 201 bp, Homo sapiens
agttctttgccaatgatttgcaaacattatctccagtcttgattctttcctaggctttatttctaaatactcactagtcatttccacttagaagctttgtmttcttttcaaactcagcatatccaaaactgacctcatcttgttgccctaactagaacatgccacaacccatttctgcctataatgtcattattctcttaa

SEQ ID NO: 66358 - DNA, 201 bp, Homo sapiens
tgctatcagagtacatggaagtagaggtttcaggttattcttatcaagacttctctagttataatgtgtcatcaatagctgattcttctttctggcaggcrgagatggtccacacaggtttgaagttggagcgagctctgttggttacagcttctcagtgtcaacagccagcagaagtaagttcactactagctggtttca

SEQ ID NO: 66359 - DNA, 201 bp, Homo sapiens
aggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacat

SEQ ID NO: 66360 - DNA, 201 bp, Homo sapiens
tcagcactgttcgcgcagattaatcagggggagagcattacacatggtgagtgagcacttggacacgaacagtaggtacaacaagttgtgtgggccagacsccaccaaccagaaccgtctgtaaactacaaccctggcttgtgtggtggagactcgtttggtgtgtcctgttcctttaagggacggcaaagctggcttaaa

SEQ ID NO: 66361 - DNA, 201 bp, Homo sapiens
caggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgaca

SEQ ID NO: 66362 - DNA, 201 bp, Homo sapiens
tatggacagagctgcaggcttacattaaggagttccataccaccggactggcctggagcaaaacggttagtgaatccttcctccctccctccctccctccyactttctctctccagcatggggtccacaggtttcttagacttcagcactaccaaagtctgtgagggaatgctagttttttcagtggaagggaggaagaaa

SEQ ID NO: 66363 - DNA, 201 bp, Homo sapiens
ctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtga

SEQ ID NO: 66364 - DNA, 201 bp, Homo sapiens
tagaaaagctgccattgagcggagcctaagaaacaccacgggtaggagaatgtgagcccataggaaagaagggttctggagtcaccactgttatgtacccrgatcacctgtgacaagttcttctttaatcctcccagggataagaagcatgtagactgggtcaaagcttatttaagtatatggacagagctgcaggcttac

SEQ ID NO: 66365 - DNA, 201 bp, Homo sapiens
aggaacaaggtagctgttgttcttacagccctgaaacatgtatctgatgacatgaagactcacaagaaccctgccctgaaggctcagagtggtccagtacrcagtggccccaaaccattctctgcacctaaaccccaaaccagcccatcccccaaacgagccacaaagaaggagccagctgtacttgaactggagggcaag

SEQ ID NO: 66366 - DNA, 201 bp, Homo sapiens
cctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtg

SEQ ID NO: 66367 - DNA, 201 bp, Homo sapiens
aaatatatgtagaaaacaatattgtagagttgcaaatgccaacactgactgaggaggtgggggaagtagggttagctgtggggagtgagggtatttttttyttttccttttaccaaattttctttactaccactcatttttctttattgctttaaaaattacatatttgtgcacatacatttgatatgtctttctagacat

SEQ ID NO: 66368 - DNA, 201 bp, Homo sapiens
acctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgt

SEQ ID NO: 66369 - DNA, 201 bp, Homo sapiens
cgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcctg

SEQ ID NO: 66370 - DNA, 201 bp, Homo sapiens
tgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttacttt

SEQ ID NO: 66371 - DNA, 201 bp, Homo sapiens
tgtgcacatacatttgatatgtctttctagacatagaggataaggatttacatatccttatcctcacccacaatatacacacattccatgttgttgttaayggaaccatataatttaatcttggggagaagagaaatgataaaagtacttttccaaaactgcttgcaagagaacatctcaaaggctctggttttggctttg

SEQ ID NO: 66372 - DNA, 201 bp, Homo sapiens
gcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcct

SEQ ID NO: 66373 - DNA, 201 bp, Homo sapiens
ctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactt

SEQ ID NO: 66374 - DNA, 201 bp, Homo sapiens
cctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttact

SEQ ID NO: 66375 - DNA, 201 bp, Homo sapiens
tcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttac

SEQ ID NO: 66376 - DNA, 201 bp, Homo sapiens
actcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggtttt

SEQ ID NO: 66377 - DNA, 201 bp, Homo sapiens
tgtatgaaggaacatgttttaataacagaactgagtggtatctgttcatggaaggtagcttaggagtttattgcgttccttgccttttcccctggacttayagtgtggtggattgtatatatatgtgagtctgtctcttgatcagtatgcataatggaacagggcaggaattcagatatcagttgatagtgtcataacatt

SEQ ID NO: 66378 - DNA, 201 bp, Homo sapiens
caagtagctgggactacaggcgcataccaccacgcctggctaagtagagacgaggtttcactgtgcttcccagctggtctcgaactcctgagctcaggcartccacccgtctcggcctcccaaagtgctaggattacaggcgtgagccaatgtacagtgtttttaatgcctcctatgtttatagtagtggaattacagtgg

SEQ ID NO: 66379 - DNA, 201 bp, Homo sapiens
ttccacttctgctttctctccttttttggtagaggcccttttagtcttctgatccttacccttctgggtttaggaagttttgctggcagtaacatggactratgccctttatataagattttgttcctttgttgagaatttgttactggcccaatggcaaagggttcaataggacttaatagaaatttttcatgaagtcag

SEQ ID NO: 66380 - DNA, 201 bp, Homo sapiens
gtggcgcaatctcagcttactgcaacctccacctctcaggttcaagcaattctcatgcctcagcctcccaagtagctgggactacaggcgcataccaccaygcctggctaagtagagacgaggtttcactgtgcttcccagctggtctcgaactcctgagctcaggcaatccacccgtctcggcctcccaaagtgctagga

SEQ ID NO: 66381 - DNA, 201 bp, Homo sapiens
cagttctgacttctccattgctggttttgagctggaatgattgcaggcaaaatttattaagttgcatatctacacaagcctttcctttcttccatccttcrtcaatcaacaaacatttattaactactctttttaaggaaaactacaccttcctgtgagtgaaatgtgtcccagaacaacaggcacttccttatccttcta

SEQ ID NO: 66382 - DNA, 201 bp, Homo sapiens
tggggctggatactgtgattaaccatatagtcacttaatttgttaaaagccattgtggagtagcaagaagagctgcagagtaggattcagaatatttgtaytctaggcctaggttctttactcactagttgtttgacctctggcaagtttttttttttgagacggagttttgctcttgttgcccaggctggagtgtaatgg

SEQ ID NO: 66383 - DNA, 201 bp, Homo sapiens
aactaagttttctatctctaagcgtgtagtaatcatccttctattcctgaatagttgtcgggaggctcaaactgagataatgtatgtgactatcctttgcwaattctaactttctacacacagtatcatagtaaatattgagtatttgaatgagtaagcatttactttagtgaacaccttttcctgagcagttctcttgct

SEQ ID NO: 66384 - DNA, 201 bp, Homo sapiens
tcagtcagccaaggtcctcatccttggtttaagagctccttgagaagttcctcttggtttggggcattacacatgttctttctcttttgcctgtactgagsagttcagtccagccacagaaacgattcctcatttttttctaggccccttgcttttatcacgtatttatacagaaagcttgcttggtacataaaatatggt

SEQ ID NO: 66385 - DNA, 201 bp, Homo sapiens
agcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcc

SEQ ID NO: 66386 - DNA, 201 bp, Homo sapiens
aagcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctc

SEQ ID NO: 66387 - DNA, 201 bp, Homo sapiens
ggtccattatggctgacatgcaaaatctggtagaaagattggagagggcagtgggccgcctggaggcagtatctcatacctctgacatgcaccgtgggtaygcagacagtccttcaaaaggtaagcagtccacagcccagcagaatgctttctttgagcgtcttggcctgaaaattttctattattctctcctttggcgct

SEQ ID NO: 66388 - DNA, 201 bp, Homo sapiens
tggtgagttaaaaatacctagacaggggcaggtatttttattattttatttttttgagatggagtttcactttgtcgcccaggctggagtgcagtggcgcratttcggcttaccgcaacctccgcctcccggggaaaaggagtaggaacaggaggttaaatggagcttagctagatgagggcagagttctggcttcaattg

SEQ ID NO: 66389 - DNA, 201 bp, Homo sapiens
aaagcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttct

SEQ ID NO: 66390 - DNA, 201 bp, Homo sapiens
aactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttt

SEQ ID NO: 66391 - DNA, 201 bp, Homo sapiens
aacctccacctcccaggctcaagtgattctcccacctcagcctcctgaatagctgggactacaggcatgcgccaccatgcccagctgatttttgtattttyatagagatggggtttccccatgttgcccaggctgatcttaaactcctggactcaagcgatctgcccaccttggcctcccaaagtgctgggattacaggcg

SEQ ID NO: 66392 - DNA, 201 bp, Homo sapiens
gaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggtt

SEQ ID NO: 66393 - DNA, 201 bp, Homo sapiens
tggagctttggaggaagggtgcaaacacaaacaaagttcatccattttgccaaggtgcctatttgaatgctaagcccctaattgttttttattttatttaygtttaaaaaaaaatttttttttttagacagggtgttgttttgtcacccagactggagggtagtggtgcaatcacagctcactgaagccttgacctcccag

SEQ ID NO: 66394 - DNA, 201 bp, Homo sapiens
tcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtagg

SEQ ID NO: 66395 - DNA, 201 bp, Homo sapiens
gcttcactgtggatgggctttagtagtgctcctgtggagatcttaaaactcctacagtattgcttctctcctcatccttcactggttgggagactctctctttaattttactcccacctcaaaattttatggtgcaagatgtgaaaagttgaattagagaaaatttagatttctcttggagtcaaagaatataggtttcct

SEQ ID NO: 66396 - DNA, 201 bp, Homo sapiens
ctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtag

SEQ ID NO: 66397 - DNA, 201 bp, Homo sapiens
tgcttcactgtggatgggctttagtagtgctcctgtggagatcttaaaactcctacagtattgcttctctcctcatccttcactggttgggagactctctctttaattttactcccacctcaaaattttatggtgcaagatgtgaaaagttgaattagagaaaatttagatttctcttggagtcaaagaatataggtttcc

SEQ ID NO: 66398 - DNA, 201 bp, Homo sapiens
ggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtg

SEQ ID NO: 66399 - DNA, 201 bp, Homo sapiens
ttgcttcactgtggatgggctttagtagtgctcctgtggagatcttaaaactcctacagtattgcttctctcctcatccttcactggttgggagactctctctttaattttactcccacctcaaaattttatggtgcaagatgtgaaaagttgaattagagaaaatttagatttctcttggagtcaaagaatataggtttc

SEQ ID NO: 66400 - DNA, 201 bp, Homo sapiens
gctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcat

SEQ ID NO: 66401 - DNA, 201 bp, Homo sapiens
ccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggta

SEQ ID NO: 66402 - DNA, 201 bp, Homo sapiens
cttgcttcactgtggatgggctttagtagtgctcctgtggagatcttaaaactcctacagtattgcttctctcctcatccttcactggttgggagactctctctttaattttactcccacctcaaaattttatggtgcaagatgtgaaaagttgaattagagaaaatttagatttctcttggagtcaaagaatataggttt

SEQ ID NO: 66403 - DNA, 201 bp, Homo sapiens
gccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggt

SEQ ID NO: 66404 - DNA, 201 bp, Homo sapiens
ccttttcctgagcagttctcttgcttaatgaggtcttttgattttgtaaatatgctacttttttatctgatatttttgtattgttccattttgcagatgayatctaattttattaaattattctgttcctgagaattggcatcctcttcatccacctggggatgaccaggaattttctgtttttttctctgtaggtgctat

SEQ ID NO: 66405 - DNA, 201 bp, Homo sapiens
ggccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctgg

SEQ ID NO: 66406 - DNA, 201 bp, Homo sapiens
ttggccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttct

SEQ ID NO: 66407 - DNA, 201 bp, Homo sapiens
tccatgcttatcacttttctcacattatgatttactttcttaggataaaacctcaggaacaggattacaaaattaagagaagcattttgaagcaaatcaaytgggctaccatagtagacaggctgatttgtatgggtgctttattttcaattttacctaaggatgatgacttagaaaaacaactgtgggacaaagtagaaa

SEQ ID NO: 66408 - DNA, 201 bp, Homo sapiens
ttttctctctttttttcttttctgagacagtgtcttgcgttgtcacccaggctgaagtacagtggcacaatcacagctcattgcagcctcaacctcccagstcaaacaatcctcccacctcagtcctccaagtagctgggacttcaggcacgctccaccatgcctggctaattttctaattttttcgtagagatgaggtct

SEQ ID NO: 66409 - DNA, 201 bp, Homo sapiens
acaaatattgtaaattttgcgttcaagtttttttccacacttcatttagctattcccctataattagaagtccaagatagatatagatagatcaatagatmtaacattgcagcaaacatctccatgcttatcacttttctcacattatgatttactttcttaggataaaacctcaggaacaggattacaaaattaagagaa

SEQ ID NO: 66410 - DNA, 201 bp, Homo sapiens
tgttaaaagaaagtttggaaaacaggtagaaattgtcaaaaacccatcacccaaatgtgacaaatattgtaaattttgcgttcaagtttttttccacactkcatttagctattcccctataattagaagtccaagatagatatagatagatcaatagatctaacattgcagcaaacatctccatgcttatcacttttctca

SEQ ID NO: 66411 - DNA, 201 bp, Homo sapiens
tattattataaaatattatatgttaaaagaaagtttggaaaacaggtagaaattgtcaaaaacccatcacccaaatgtgacaaatattgtaaattttgcgwtcaagtttttttccacacttcatttagctattcccctataattagaagtccaagatagatatagatagatcaatagatctaacattgcagcaaacatctc

SEQ ID NO: 66412 - DNA, 201 bp, Homo sapiens
gcacctgaacagaggactgaaacctccactgcaggctggttttaggtcttgaattatgtaagaatcttgcacagcactgctaatgtaaatttcagttgttyttccctctaggacaaacacttaccaaaatatgcaacttttttttggtgggaagagagattgtcctgtgatttctacccatttcctgaggcctgtggaaat

SEQ ID NO: 66413 - DNA, 201 bp, Homo sapiens
gtagagatttttattattattataaaatattatatgttaaaagaaagtttggaaaacaggtagaaattgtcaaaaacccatcacccaaatgtgacaaataytgtaaattttgcgttcaagtttttttccacacttcatttagctattcccctataattagaagtccaagatagatatagatagatcaatagatctaacatt

SEQ ID NO: 66414 - DNA, 201 bp, Homo sapiens
gtcacctgtcttcactgcctccttttccctgtcatgctcatcagcttatggcttctgtctaagcacctgaacagaggactgaaacctccactgcaggctgrttttaggtcttgaattatgtaagaatcttgcacagcactgctaatgtaaatttcagttgtttttccctctaggacaaacacttaccaaaatatgcaactt

SEQ ID NO: 66415 - DNA, 201 bp, Homo sapiens
ggaagtagggttagctgtggggagtgagggtatttttttcttttccttttaccaaattttctttactaccactcatttttctttattgctttaaaaattayatatttgtgcacatacatttgatatgtctttctagacatagaggataaggatttacatatccttatcctcacccacaatatacacacattccatgttgtt

SEQ ID NO: 66416 - DNA, 201 bp, Homo sapiens
ggtgatccgcctgccttggcctcccagagtgtgggattacaggcatgagccacagcgcctggcctagaaagatattaaactacaggttaacatgagaaagwttttaagtgtcaatagttgaactaaatttgttaacaatctgtatgattataaccaacaaaaccaaatatatgtagaaaacaatattgtagagttgcaaat

SEQ ID NO: 66417 - DNA, 201 bp, Homo sapiens
ttgaggggagagtgagtaagagcctttatttatttattttcttactcaaacacctttattagcccactgttcttttttttttttttggaaacataatctcrctctgttgtccaagctggagtgcagtggcgcaatctcagcttactgcaacctccacctctcaggttcaagcaattctcatgcctcagcctcccaagtagc

SEQ ID NO: 66418 - DNA, 201 bp, Homo sapiens
acacaaacaaagttcatccattttgccaaggtgcctatttgaatgctaagcccctaattgttttttattttatttatgtttaaaaaaaaattttttttttkagacagggtgttgttttgtcacccagactggagggtagtggtgcaatcacagctcactgaagccttgacctcccaggtgtaatgatcctcccacctcagc

SEQ ID NO: 66419 - DNA, 201 bp, Homo sapiens
tcggtcaattttgggaccatctgtggaaccaccatgtgtgatcagacacccaacacacccgaggcacagtggtgcagaggagcgtctaatctttccagggmaggggtggagggattaaaggtcagggtgaccgactcacacaggactcgcagctggacgctactgttcctgtgcaagaactcgccgtccacctcgagagtg

SEQ ID NO: 66420 - DNA, 201 bp, Homo sapiens
tatctgaaatctactgagcaactgacagaggaagttcaatctaaggctttctttctcttatctaatggtgagaagatttaagtaatttctgcccataattkttgaaagcaattgttactcataccaagatgtcataagctgtttttatgcagtagtctggtgaaagaaaagtgaacctgaaccgaggaactctcagtccta

SEQ ID NO: 66421 - DNA, 201 bp, Homo sapiens
ctgttgtgggtaagttgatcaaattttgtgtttcactatgatttgaaaatcttggttgaggtggtctttaaaaatccttaaaataacagaatggagagatyttcctaagctatcaattggagggaattattgttcagatcatcctctatgtttcctgatgggatctaaagggattacagtaccgtttccggacctgtattc

SEQ ID NO: 66422 - DNA, 201 bp, Homo sapiens
atcttggttgaggtggtctttaaaaatccttaaaataacagaatggagagatcttcctaagctatcaattggagggaattattgttcagatcatcctctakgtttcctgatgggatctaaagggattacagtaccgtttccggacctgtattcccaggaaaccttagcttgggtagatggtaactagtgttcagaaagcaa

SEQ ID NO: 66423 - DNA, 201 bp, Homo sapiens
gtgatgaaactgtggaattgctgacattgtcacttcctctttatctaacttttgctttggtgatttgtattacaggctcagtgctcttacttttaagacaytggagagaatgaaaaaatatgtattcattgatgaaaatgttcaaaaacagaccttaatctggctttcaagccaacagaaaacaagcggctgctttaagaa

SEQ ID NO: 66424 - DNA, 201 bp, Homo sapiens
ggaagttcaatctaaggctttctttctcttatctaatggtgagaagatttaagtaatttctgcccataatttttgaaagcaattgttactcataccaagaygtcataagctgtttttatgcagtagtctggtgaaagaaaagtgaacctgaaccgaggaactctcagtcctagcgctgttttccgtctgacttcaaaatct

SEQ ID NO: 66425 - DNA, 201 bp, Homo sapiens
tatgcagtagtctggtgaaagaaaagtgaacctgaaccgaggaactctcagtcctagcgctgttttccgtctgacttcaaaatctgtgtggtcagctagcktcataatttacagctgcaaagttttcaagctatgcacttaatttttttttaatgtctggtattttgcaagctaccttgtttattgttgttattattgttg

SEQ ID NO: 66426 - DNA, 201 bp, Homo sapiens
catcctttactcaaagggaacaatggtgatgaaactgtggaattgctgacattgtcacttcctctttatctaacttttgctttggtgatttgtattacagrctcagtgctcttacttttaagacattggagagaatgaaaaaatatgtattcattgatgaaaatgttcaaaaacagaccttaatctggctttcaagccaac

SEQ ID NO: 66427 - DNA, 201 bp, Homo sapiens
gctgacattgtcacttcctctttatctaacttttgctttggtgatttgtattacaggctcagtgctcttacttttaagacattggagagaatgaaaaaatwtgtattcattgatgaaaatgttcaaaaacagaccttaatctggctttcaagccaacagaaaacaagcggctgctttaagaatgatggccagcttttcaac

SEQ ID NO: 66428 - DNA, 201 bp, Homo sapiens
tgtttttgttaggagttgttgtcagtggttcatctatcaacgtctgtatttgtttgctcagctgtggtctgttgcagtgaagtgattggctttgtatacasaaagagggccaatgttgtgaactgtgaggttaaggaaaagtccaggagcataaaataatcttctttggtttttcttctcagaaagataacactgaaataa

SEQ ID NO: 66429 - DNA, 201 bp, Homo sapiens
attctaggtgccaaagcctccaagcagggagttttggacttgccaaatgatgtagtagaagggtcagccagaggctttttcactgttgtgggtaagttgawcaaattttgtgtttcactatgatttgaaaatcttggttgaggtggtctttaaaaatccttaaaataacagaatggagagatcttcctaagctatcaattg

SEQ ID NO: 66430 - DNA, 201 bp, Homo sapiens
cagtggttcatctatcaacgtctgtatttgtttgctcagctgtggtctgttgcagtgaagtgattggctttgtatacacaaagagggccaatgttgtgaamtgtgaggttaaggaaaagtccaggagcataaaataatcttctttggtttttcttctcagaaagataacactgaaataaaatgaccttaggggaaatatac

SEQ ID NO: 66431 - DNA, 201 bp, Homo sapiens
caacgtctgtatttgtttgctcagctgtggtctgttgcagtgaagtgattggctttgtatacacaaagagggccaatgttgtgaactgtgaggttaaggamaagtccaggagcataaaataatcttctttggtttttcttctcagaaagataacactgaaataaaatgaccttaggggaaatatactgaatagttagtagg

SEQ ID NO: 66432 - DNA, 201 bp, Homo sapiens
aggagaaatgtttgttgttgatacgaaaggcaaacttctttgtctgttattaacatgaacatctcttggaagggatggattacactttgtaattcataggrttgattgattaaaaaaaaaactagcaaacaagcaaacaaatgcattctcctaacttcctcctctctctagtaatgagattttcagaaatatttttcatag

SEQ ID NO: 66433 - DNA, 201 bp, Homo sapiens
tgctagtcataatattttcctgacccaaaggaaagggccactaacaataaagatggtttacagtagatgagttgaatgcatcctttactcaaagggaacartggtgatgaaactgtggaattgctgacattgtcacttcctctttatctaacttttgctttggtgatttgtattacaggctcagtgctcttacttttaaga

SEQ ID NO: 66434 - DNA, 201 bp, Homo sapiens
atattttcctgacccaaaggaaagggccactaacaataaagatggtttacagtagatgagttgaatgcatcctttactcaaagggaacaatggtgatgaamctgtggaattgctgacattgtcacttcctctttatctaacttttgctttggtgatttgtattacaggctcagtgctcttacttttaagacattggagaga

SEQ ID NO: 66435 - DNA, 201 bp, Homo sapiens
ctgctgatataaagaagccatcacattttttaaatcagtattttcattctaggtgccaaagcctccaagcagggagttttggacttgccaaatgatgtaghagaagggtcagccagaggctttttcactgttgtgggtaagttgatcaaattttgtgtttcactatgatttgaaaatcttggttgaggtggtctttaaaaa

SEQ ID NO: 66436 - DNA, 201 bp, Homo sapiens
ataaaactaaagatttagtgattccaattctaatgcaacaatgttccttcagtctcatgacgatttgcttagcagtctgatcccttcatgacagcccctakacatgcaccgctggttaactccaccgaagagggcacggcacgtcttactctgtgcttctcagagtcccatatagattcgggaaagtgaaattagaaggac

SEQ ID NO: 66437 - DNA, 201 bp, Homo sapiens
tttcctacaatgttctattttaggttatcaaaggcaattatctttcaaaaactctgatggttcctatagtgtgttttggcagcagagtcagaaaggaagcmtatggtgagacataaaaattttattttatataatataggaattacctgaggagggcttgcaaggaggtgaaggaggatagagttcagtggggatttagaa

SEQ ID NO: 66438 - DNA, 201 bp, Homo sapiens
ttaatttttttttaatgtctggtattttgcaagctaccttgtttattgttgttattattgttgtttttgttaggagttgttgtcagtggttcatctatcarcgtctgtatttgtttgctcagctgtggtctgttgcagtgaagtgattggctttgtatacacaaagagggccaatgttgtgaactgtgaggttaaggaaaa

SEQ ID NO: 66439 - DNA, 201 bp, Homo sapiens
actgacagaggaagttcaatctaaggctttctttctcttatctaatggtgagaagatttaagtaatttctgcccataatttttgaaagcaattgttactcrtaccaagatgtcataagctgtttttatgcagtagtctggtgaaagaaaagtgaacctgaaccgaggaactctcagtcctagcgctgttttccgtctgact

SEQ ID NO: 66440 - DNA, 201 bp, Homo sapiens
aggttaaaaaataatttcctacaatgttctattttaggttatcaaaggcaattatctttcaaaaactctgatggttcctatagtgtgttttggcagcagartcagaaaggaagcatatggtgagacataaaaattttattttatataatataggaattacctgaggagggcttgcaaggaggtgaaggaggatagagttca

SEQ ID NO: 66441 - DNA, 201 bp, Homo sapiens
cagaggctttttcactgttgtgggtaagttgatcaaattttgtgtttcactatgatttgaaaatcttggttgaggtggtctttaaaaatccttaaaataayagaatggagagatcttcctaagctatcaattggagggaattattgttcagatcatcctctatgtttcctgatgggatctaaagggattacagtaccgttt

SEQ ID NO: 66442 - DNA, 201 bp, Homo sapiens
tcactatgatttgaaaatcttggttgaggtggtctttaaaaatccttaaaataacagaatggagagatcttcctaagctatcaattggagggaattattgwtcagatcatcctctatgtttcctgatgggatctaaagggattacagtaccgtttccggacctgtattcccaggaaaccttagcttgggtagatggtaact

SEQ ID NO: 66443 - DNA, 201 bp, Homo sapiens
ctttttcactgttgtgggtaagttgatcaaattttgtgtttcactatgatttgaaaatcttggttgaggtggtctttaaaaatccttaaaataacagaatrgagagatcttcctaagctatcaattggagggaattattgttcagatcatcctctatgtttcctgatgggatctaaagggattacagtaccgtttccggac

SEQ ID NO: 66444 - DNA, 201 bp, Homo sapiens
atataatataggaattacctgaggagggcttgcaaggaggtgaaggaggatagagttcagtggggatttagaagcaaagtgggtttcaaagtcaatttacrgaagagaaatagataaaactaaagatttagtgattccaattctaatgcaacaatgttccttcagtctcatgacgatttgcttagcagtctgatcccttca

SEQ ID NO: 66445 - DNA, 201 bp, Homo sapiens
ttctaggtgccaaagcctccaagcagggagttttggacttgccaaatgatgtagtagaagggtcagccagaggctttttcactgttgtgggtaagttgatyaaattttgtgtttcactatgatttgaaaatcttggttgaggtggtctttaaaaatccttaaaataacagaatggagagatcttcctaagctatcaattgg

SEQ ID NO: 66446 - DNA, 201 bp, Homo sapiens
gcatctgatacttatgttctggactatctgaaatctactgagcaactgacagaggaagttcaatctaaggctttctttctcttatctaatggtgagaagawttaagtaatttctgcccataatttttgaaagcaattgttactcataccaagatgtcataagctgtttttatgcagtagtctggtgaaagaaaagtgaacc

SEQ ID NO: 66447 - DNA, 201 bp, Homo sapiens
ggaactgagggttccttctttttttagactgtatagggtaacttcctgatgttgccatggtatttataaactgtcatggccctagtgggagagtcttttarcatgctaatgcattataattagtgtataatgagcactgaggacaaccagaggtcacctttgtcaccatcttggttttggtaggtttgggctatctttatc

SEQ ID NO: 66448 - DNA, 201 bp, Homo sapiens
cgagtagctgggattacaggcaccacctaattagcccgccaccacgcccggctaatttttgtatttttagtagagacggggtttcaccatcttggctaggmtggtcttgaactcctgacctcgtgatccacccgcctcggcctcccagagtgctgggattacaggcgtgagccaccgcacctggcctaaaactgatttttt

SEQ ID NO: 66449 - DNA, 201 bp, Homo sapiens
acaggcgtgagccaccgcgcctggccagaatcccagttttttaacacatctaatgctttaggaatagtaaatggaaacatcatttccccttctttcgaagyacttctaccttgatgagatgtatgtattggagtacaatatttgacctagccaagaatttcacaaaagaagcccaaaatatgattttcacgtttactggac

SEQ ID NO: 66450 - DNA, 201 bp, Homo sapiens
tagctatagctcgacccttaacagctaatcaggtaaactcttcaactcagttttgaacgtaacatagtatactacagactttttgtttttgtcctcagagstaaagagaaacaatggctatatggcatactatgaggattaattttatatgtctacttgactgggccatagggtgcccaatatatggtcaaacattatttt

SEQ ID NO: 66451 - DNA, 201 bp, Homo sapiens
ttgcttgaaccagggaatcaggttgcagtgagctgagatcatgccactgcattgcaatctggcgacagagcgagattctgtctcaaaaaaaaaaaaaaaaattagagcatgcctataatctgagctactcaggaggctgagacacgagaatcacttgaacccagggcggcggaggtgcagtgagcagcgatcacaccactg

SEQ ID NO: 66452 - DNA, 201 bp, Homo sapiens
ctctactaaaaatacctgggcaaagtagagcatgcctggccgggcgcagtggctcatgcctgtaatcccagcactttgggaggctgagacaggtggatcakgaggtcaggagatcgagaccatcctggccaacatggtgaaaccctgtctctactaaaaatacaagaattaactgggcatggtggcacatgcctgtaattc

SEQ ID NO: 66453 - DNA, 201 bp, Homo sapiens
ttgtgatctgcccacctcggcctcccaaagtgctgggattacaggtgtgagccactgcgcccggcctatttcttcttctctttgtttagttattatctatwactctcattcctatgaacataacttgtttctccccacttaatttttatcatacataattgtagacagtgggcactgtcttcaattatagtgaatttagca

SEQ ID NO: 66454 - DNA, 201 bp, Homo sapiens
agcttgcacgtgggaggcggaggttgcagtgagccgagatcctgtcactgcactccagcctgggcgacaaagcgagactctcaaaaaaaaaaaaaaaaaargcacgtaataaatcaaatatgcattatgtaatcacaaaatccagcttaacaactaaataataatttaaaagatattaaaaacttaatatggaagaaaaat

SEQ ID NO: 66455 - DNA, 201 bp, Homo sapiens
ttgcatttctcaaaacacttttttttcttttgctgtatttataccaagtcactttttgtttgtttgttggttggttggttggttggttggttggttggttkgttggagtcggaatctcactctgttgccgaggctggagtgcagtagagtgatcttggctcactgcaacctctgcctcccaggttcaagcgattctcctgc

SEQ ID NO: 66456 - DNA, 201 bp, Homo sapiens
tgtatttttagtagagacagggtttcaccatgttagccagactggtcttgaactcctgaccttgtgatccacccgccttggcctcccaaagtgctgggatwacaggcgtgagccaccgcgcctggccttctttttctttttcttagagacagggtctcactctgttacccaggctgcagtgcagtggcacaatcatagttc

SEQ ID NO: 66457 - DNA, 201 bp, Homo sapiens
ctgggtgacagagcaactaactaactaactaactaaaactacagttagtttatatatagtttttagttaaaactatagttagtttgagccaggcgcggtgsctcacgcctgtaatcccagcactttgggaggccgaggcgggcggatcacgagaataaggagatcgagaccatcctggctaacaaggtgaaaccccgtctc

SEQ ID NO: 66458 - DNA, 201 bp, Homo sapiens
gagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaacc

SEQ ID NO: 66459 - DNA, 201 bp, Homo sapiens
ggaactatgcacagaactttacagaacaggggcgatgctttaactgaaggctgactactgaccagagaatggaattctgagagggctcaaggaataaaagraaactaggcagggaaagggaaggcgcccatctgaagcaaacttcagcggccatcaggatatcttgtggtggtcacaagttgtaggctctgtttttggaag

SEQ ID NO: 66460 - DNA, 201 bp, Homo sapiens
ggagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaac

SEQ ID NO: 66461 - DNA, 201 bp, Homo sapiens
ttgggacagggtcttgctgtgttgcccaggctggtttctaactcctgggctcaagcgatccactggcctcagcctcctgaagtgctgggattacaggagtsagccactgcaccaggcccatttctctaccatttctgatctctctctagaaacacttggataactgcacagctcctttcataagaaatatattttagggcc

SEQ ID NO: 66462 - DNA, 201 bp, Homo sapiens
gggagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaa

SEQ ID NO: 66463 - DNA, 201 bp, Homo sapiens
cacggcactccagcctggccgacagactctgtctcaaaaaaaaaaaaagatttatagttttggctgggcgtggtggctcatgcctataatcccagcatttkgggaggccaaggcaggtggataactttaggccaggagtttgagaccagccgggctgacataacaaaacctgatctctactaaaagtacaaaacttaggct

SEQ ID NO: 66464 - DNA, 201 bp, Homo sapiens
atgatacctttgagagatgtcttacatttgtcttttctttcagcaaaatgtgatgccagtccctgaaatgtgtagcaatttaattatgggtagcattcttytttccctgtacttactatagtattaacttactactaatgctaagaagtttataatttttgataattcagatttggattagattaagatttatgtctatgc

SEQ ID NO: 66465 - DNA, 201 bp, Homo sapiens
gaaagaaagagccagttcacagtgcgcctttgtattcggcgggaaacccggccgaagagggagctggaaaggactccggaatccggccgtaattccagccmatcagggagtagagttgcggggcggggttggggcggggcagtctcgcgggagatagtttcgcgggttcgggaggcgagtctccggtttccgcccagtctc

SEQ ID NO: 66466 - DNA, 201 bp, Homo sapiens
tgtcaaaaaagattgtaggtaccttgtttaaagaaaatatataagctagtttcaagaattccaaaatattttttaaaagcagctctgtacatgtcgataarttatttgctcattgtaattttttgaatctgtttgtcaaagcaaatgtagacgggctcgaactcctgacctcaaatgatccacccgcctcagtctcccaaa

SEQ ID NO: 66467 - DNA, 201 bp, Homo sapiens
atctgtttgtcaaagcaaatgtagacgggctcgaactcctgacctcaaatgatccacccgcctcagtctcccaaatgctggtattacaggcatgagccacygctcatggcctgttatcatttttaattgaaaattttactgagataattgtagattcacttgccattataagaaataattcagagatatcacttgtatact

SEQ ID NO: 66468 - DNA, 201 bp, Homo sapiens
actacaggtgcatgccaccatgcctggctaatttttgtgctttttcgtgtataaagatgagatttcgccatgttgcccaggctggtctcaaactcctgggmtcaagagatctgtccacctcagcctcctaaagcgctgagattacaggcatgagccaccacgtccagcctagagatatttatactttaatagctgcctgca

SEQ ID NO: 66469 - DNA, 201 bp, Homo sapiens
acttgccattataagaaataattcagagatatcacttgtatacttagcccagtgtcccccaaaggtaaaattttgcaaaattatagtctaatgtaacagcrtgaatattgacattaatacaatccactgagtttattcagatttccccagttttacttgtattcaattgtgtgtttgtgtattaagttcgatataactagt

SEQ ID NO: 66470 - DNA, 201 bp, Homo sapiens
tccagaccccaagagcaggttactggatcttgcacaggaaataattcaagggaagtcacacagcacagagaaaaagcaagttcatacaatgttactgagtwagttatcgccagaaagcaggaggaggaacacgccatccttgttagtgtctctatttataagaaacttatgagaagctataattaaacttggaacatgcag

SEQ ID NO: 66471 - DNA, 201 bp, Homo sapiens
gtgacagagctagaccctgtctgaaaaaaaaaaaaaatgttagtagcagcagagcacagtggctcatgcctgtaatcccaacactatgggagtctgaggcrggaggatctcttgagcttaggagttcaagaccagcctgacaacatagtaagactccatctctacaaataatcattaaaaaaattagccgggcgtagtggc

SEQ ID NO: 66472 - DNA, 201 bp, Homo sapiens
ttggaacatgcagatgtgctcactaaaggtaggggctattggtgttatagatgaccattaatctttcaacctaagcctgctcattaatggcatctttaatraagtgggctacactcttaggacatctggacattctgcaggattggtgggagatgttctgtatggccaccaatattctgtaattataattggtggtcagct

SEQ ID NO: 66473 - DNA, 201 bp, Homo sapiens
tttcttttttttctttttcttttttattttttgaggcagagttttgctctgttgcccaggctagagtgcagtggcgcgatctcggctcactgcaacctccrcctcctgggttcaagcgattctcctgcctcagcctccctagtagcttgtttcttagagacagtgtgagtgaaactcattaagtaaagtcaatacagcaca

SEQ ID NO: 66474 - DNA, 201 bp, Homo sapiens
ttcacttcttactaaatgcagcatagcatactacatcttttgagtgtgtaaaaaataaagtagtcatgtacaaacctaaaatcacagaataatcatgtaayggtgctatattttatttttactttagattcctaatacatttttattgtatctttataaggttagtttgggagaatagcactatcatcatctatattagtt

SEQ ID NO: 66475 - DNA, 201 bp, Homo sapiens
tattttctcccaatttgtgggtcatctttccactttcctaaaagtgtcatttcaagcaaaaattttaattttgatggagttgtgtgtgtgtgtgtgtgtgkatgtgtatgtgtgtctttggtgtcatagctgagaaattattgtcaaatccaggatcatgaaagatttacatctatattttcttttaagagttatagtttt

SEQ ID NO: 66476 - DNA, 201 bp, Homo sapiens
cgggaaacccggccgaagagggagctggaaaggactccggaatccggccgtaattccagccaatcagggagtagagttgcggggcggggttggggcggggmagtctcgcgggagatagtttcgcgggttcgggaggcgagtctccggtttccgcccagtctctggggacgcggtggcggggtctgaatcgcctggcttcca

SEQ ID NO: 66477 - DNA, 201 bp, Homo sapiens
ttttaaatgataaagacaggttaataaaatgtataatattatgttgctatatccaaaaaaaggccttctttgattacactatcaaaagttacctctccatytacatccccattactatctcattaacctgttttattcatagcacttactaccatctaaaatgactttatttctttatatttttgtttgctacctgtcttt

SEQ ID NO: 66478 - DNA, 201 bp, Homo sapiens
gagtgagttaccatgagatctggttgtttaaaagtgtgtagcacctctcacctcactctattccttctgctctggccatgtaagatgtgcctgcttccccytcaccttctgccatgattgtaagtttcctgaggcttccctagccatgcttcccatgcagcctgtggaactgtgagccaattaaacctcttttctttgtaa

SEQ ID NO: 66479 - DNA, 201 bp, Homo sapiens
tgtcaaagtataatccccagtgttagggcctggtgggagctgattggatcatgggggtgtatttcccctttggtgctgttctcatgatagtgagtgagttrccatgagatctggttgtttaaaagtgtgtagcacctctcacctcactctattccttctgctctggccatgtaagatgtgcctgcttccccttcaccttct

SEQ ID NO: 66480 - DNA, 201 bp, Homo sapiens
ggcttgagtctgtgtccctgcccaaatctgatgtcaaagtataatccccagtgttagggcctggtgggagctgattggatcatgggggtgtatttcccctytggtgctgttctcatgatagtgagtgagttaccatgagatctggttgtttaaaagtgtgtagcacctctcacctcactctattccttctgctctggccat

SEQ ID NO: 66481 - DNA, 201 bp, Homo sapiens
caaagtgctgggattacaggcatgagccaccgtgcccagcccgaagttactaacttgttttggattttacgggctcacaggcagaagggacttgccttgtytcagatgagactttgttctttgggcttttgagttaatgctggaatgagttagaactttgggggaactgttgggaaggcagattgtattttgaaatgtgag

SEQ ID NO: 66482 - DNA, 201 bp, Homo sapiens
ccaacatggcgaaaccccatctctactaactacaggcaggtgcctgtaatcccagctactcaggaggctgaggcaggagaatagcttaaatccaggaggckgaggttgtggtgagctgagatcatgccattgcactccagcctgagcagcaagagtgaaactctgtctcaaaaaaaaaaaaaaaaaaaaaaaaaagattta

SEQ ID NO: 66483 - DNA, 201 bp, Homo sapiens
actccatctctacaaataatcattaaaaaaattagccgggcgtagtggcacctacctgtagtcccagctactggggaggctgagatgggaggatcacctgrgcctgggaggtcaaggctgcagtgagctgtgatcgccattgtactccaaactgggtgacaagagtgagaccatgcctcaaaaataataataataaatgta

SEQ ID NO: 66484 - DNA, 201 bp, Homo sapiens
cactaatcccttttccatttctaaaatgtgatttcaaaaatgttacatacttggctgggggcggtggctcatgcctgtaatcccagcactttggatatackgtctctactaaaaatacaaaaattagctgggagtggttgtgcacacctgtaatcccaggtgcttgggaagctgaggcaggagaattgcttgaacccagga

SEQ ID NO: 66485 - DNA, 201 bp, Homo sapiens
ctcatccccaactattgacaaccactaatcccttttccatttctaaaatgtgatttcaaaaatgttacatacttggctgggggcggtggctcatgcctgtwatcccagcactttggatatacggtctctactaaaaatacaaaaattagctgggagtggttgtgcacacctgtaatcccaggtgcttgggaagctgaggca

SEQ ID NO: 66486 - DNA, 201 bp, Homo sapiens
attttgggcctgtttgattttttgggagacaccacccagcagaaacacaccgcacttacatgcaacccctccattgcacagtttctaaatgcccccccccytttttttccattctctgatcctaaaaaaagaaatccagtggcacaatcacggatctctgcagccttgatctcttagcctcaagtgattctcctgcctcag

SEQ ID NO: 66487 - DNA, 201 bp, Homo sapiens
taagttcgatataactagtcaatatactgaacagttctaacatcacaagtatccttcaggtagcccttttgtatccacatccacttccttctcatccccarctattgacaaccactaatcccttttccatttctaaaatgtgatttcaaaaatgttacatacttggctgggggcggtggctcatgcctgtaatcccagcac

SEQ ID NO: 66488 - DNA, 201 bp, Homo sapiens
gaaaccccgtctctactaaaaatacctgggcaaagtagagcatgcctggccgggcgcagtggctcatgcctgtaatcccagcactttgggaggctgagacrggtggatcaggaggtcaggagatcgagaccatcctggccaacatggtgaaaccctgtctctactaaaaatacaagaattaactgggcatggtggcacatg

SEQ ID NO: 66489 - DNA, 201 bp, Homo sapiens
aataagaataatatttgagaaactcacacaatatgaaaagctattctattcagatgtgcacactactgtagcctatttctattttgtattggttagtatgyatcaggtcatctcataggttggggctcttctgagtcttgcatttctcaaaacacttttttttcttttgctgtatttataccaagtcactttttgtttgtt

SEQ ID NO: 66490 - DNA, 201 bp, Homo sapiens
ctaatacattgaacatctcttcatgtgcttattggccatgtgtatatcttctttgtagaaatacctattcatatttgttgtcccttttaaaattgggttgkctttttattgctgagttgtaagtgttctttatattttctggatactggacttttattaagtgtataatttgtaaatattttctcccaatttgtgggtcat

SEQ ID NO: 66491 - DNA, 201 bp, Homo sapiens
tcttttgctgtatttataccaagtcactttttgtttgtttgttggttggttggttggttggttggttggttggttggttggagtcggaatctcactctgtygccgaggctggagtgcagtagagtgatcttggctcactgcaacctctgcctcccaggttcaagcgattctcctgcctcagcctcccaagtagctgggacg

SEQ ID NO: 66492 - DNA, 201 bp, Homo sapiens
ggtctgtatgtctgtccttataccagcaccacactgtcttgattaatgtagctttgtagtaagttttgaaatgggtaagtgtgaaaaattccaacttaatytcatttttttcaagatcattctggctattttgggtcccttgcttttccatatgtattttaagatcagcttttccatgaacatggaatatttttccattta

SEQ ID NO: 66493 - DNA, 201 bp, Homo sapiens
agagaaatgtagggtagaataaggagtaaagaaagggtaaatagaaattaatactgacaattaatttttaaaaatcctatacaatttataatatatgaaaragtaaaacatatcagtagtacaagggcaagaaatggtaaatggagttaagctatcataagtgttttatttagggagtatcacaaaagtattaaagtagaa

SEQ ID NO: 66494 - DNA, 201 bp, Homo sapiens
tgcacgtgggaggcggaggttgcagtgagccgagatcctgtcactgcactccagcctgggcgacaaagcgagactctcaaaaaaaaaaaaaaaaaaagcaygtaataaatcaaatatgcattatgtaatcacaaaatccagcttaacaactaaataataatttaaaagatattaaaaacttaatatggaagaaaaatgaaa

SEQ ID NO: 66495 - DNA, 201 bp, Homo sapiens
tttctcaaaacacttttttttcttttgctgtatttataccaagtcactttttgtttgtttgttggttggttggttggttggttggttggttggttggttgkagtcggaatctcactctgttgccgaggctggagtgcagtagagtgatcttggctcactgcaacctctgcctcccaggttcaagcgattctcctgcctcag

SEQ ID NO: 66496 - DNA, 201 bp, Homo sapiens
ccacatccacttccttctcatccccaactattgacaaccactaatcccttttccatttctaaaatgtgatttcaaaaatgttacatacttggctgggggcrgtggctcatgcctgtaatcccagcactttggatatacggtctctactaaaaatacaaaaattagctgggagtggttgtgcacacctgtaatcccaggtgc

SEQ ID NO: 66497 - DNA, 201 bp, Homo sapiens
agaagaatagcttgagcccgggagacagaggttgcagtgggccaaaatcatgccacggcactccagcctggccgacagactctgtctcaaaaaaaaaaaaagatttatagttttggctgggcgtggtggctcatgcctataatcccagcattttgggaggccaaggcaggtggataactttaggccaggagtttgagacca

SEQ ID NO: 66498 - DNA, 201 bp, Homo sapiens
tttacatgataacctaaaattaattgccagtttgttttaatttactggtcaagtctatcaaatgattgaatcagcatgtttaagtggatatatctcatttrtgtccagatcattttagtatattcatgactcctcactttaaaattcaaatgataataggtacagttagtcctccatatctgtggattcaaccaagtaaaa

SEQ ID NO: 66499 - DNA, 201 bp, Homo sapiens
tttcaaaaatgctgatttttaaaatttctatcatttcttatacacttattagctcacatttttctgtaatgagtttacccttatcaagtgggactctttgkttagctgctcctctaagctaattttcttgtattctcaaagcagtttctccatactatcatttcaatacctcttgctgttctagtttgctgttttgagtat

SEQ ID NO: 66500 - DNA, 201 bp, Homo sapiens
gacgctagggacgcctgtatatggcttagattcagtgtgttagtgaaacctgctacacagtagcctgtttagagttccccatttttaaaaatactctgctyttttaaaattcattatacagccttatttctcagtactgactaaaatgtcttatttttatatatcgaagctttctatttattttttaaaccaatgtataca

SEQ ID NO: 66501 - DNA, 201 bp, Homo sapiens
atttcaaaaatgctgatttttaaaatttctatcatttcttatacacttattagctcacatttttctgtaatgagtttacccttatcaagtgggactctttkgttagctgctcctctaagctaattttcttgtattctcaaagcagtttctccatactatcatttcaatacctcttgctgttctagtttgctgttttgagta

SEQ ID NO: 66502 - DNA, 201 bp, Homo sapiens
ctttactcagattgagatattagttaaacttaagggcctgaaacaaggaaaatggggtttgcttttttctggttgtgcagagagtgtatgaataaaaagawctcacaaagttcaagtgaaagactgattaaaagaaattcatcatccaaatatcttctcagtgttaagcaagcacatgaagttagctatagctcgaccctt

SEQ ID NO: 66503 - DNA, 201 bp, Homo sapiens
gtccatacagctctgatcttttcttcttttatgctgcttgtttttccaaggcttttagtgatgcaaacttatcattactttaacaattccagctttccttytatgtcttggttttacacgacaagaagcccagaaactgaacttgcttactcagctcccgaggttgaaggtggcaagaaggtggtaagaatcctagacagg

SEQ ID NO: 66504 - DNA, 201 bp, Homo sapiens
ctcccgagagacagaggttgcagtgagccgagatcgcgccattgcactccagcccgggggaccagagcgagtcttcctctcaaaaaaaaaaaaaaaaaaaattgagatgatttaaagtgtacaggaggatgtgaataggttagatacaagcacaataccattttgtatcaaagacttgagtattcataaattttggcatct

SEQ ID NO: 66505 - DNA, 201 bp, Homo sapiens
tcggctcactgcaagctccgcctcccaggttcacgccattctcctgcctcagcctcccaagtagctgggactacaggcgcccaccaccacgcctggctaaytttttgtatttttagtagagacggggtttcaccgtgttagccaggatggtctcgatctcctgacctcgtgatccgcccgtctcggcctcccaaagtgctg

SEQ ID NO: 66506 - DNA, 201 bp, Homo sapiens
ttctggtaaattgcagatagtgaatcttttgtcttatactatcaaataggtattgactattccagctttcttatttgttgaggaagatggcagaaatcccrttttacagagggatagactttgaaggataatacccaaagctgcatagctgtggctggtataggccccaaacctgatgtttcttctctaaatctactgcct

SEQ ID NO: 66507 - DNA, 201 bp, Homo sapiens
gaaactcattaagtaaagtcaatacagcacaagtttcataaaatggtaaagaaatagaaataaaagtaaaggatgaaattcttaagaactttgtcaggccrggcgtggtggctcatgcctgtaatcccagcactttgggaggccgaggtgggtggatcacctgaggtcaggagtttgagaccagcctggccaacatggcaa

SEQ ID NO: 66508 - DNA, 201 bp, Homo sapiens
ggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgattac

SEQ ID NO: 66509 - DNA, 201 bp, Homo sapiens
gtgtcttgctctgtctcccaggctggagtgcaatggcgtgatctcagctcactgcaacctccgcctcccgggttcaagcgattctcctgcctcagcctccygagtagctgggactacaggcgcctgccaccacgcccagctaatttttatacttttaatagagacagggtttcaccatattggccaggatggtctcaatct

SEQ ID NO: 66510 - DNA, 201 bp, Homo sapiens
tccattctctgatcctaaaaaaagaaatccagtggcacaatcacggatctctgcagccttgatctcttagcctcaagtgattctcctgcctcagcttcctragtagctgggaccacaggtgcttgccaccatgcccagctatttttttttctttgtttttttgtaaagatgtgtctcactatcttgcccaggctgatattg

SEQ ID NO: 66511 - DNA, 201 bp, Homo sapiens
aggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgatta

SEQ ID NO: 66512 - DNA, 201 bp, Homo sapiens
aaattagccaggcatggtggcacgtgcctgtagtcccagctactcaagaggctgaggcaggagaatcctttgaacccgggaggcagaggttgcagtgagcygatattgcagcactgcactccagcctgggtgacagatcaaaactctgtctcagaaaaaaaaaaaaaaaaaaaaagaatttcctagaattagaatcgcagg

SEQ ID NO: 66513 - DNA, 201 bp, Homo sapiens
tcattttgggcctgtttgattttttgggagacaccacccagcagaaacacaccgcacttacatgcaacccctccattgcacagtttctaaatgcccccccscctttttttccattctctgatcctaaaaaaagaaatccagtggcacaatcacggatctctgcagccttgatctcttagcctcaagtgattctcctgcctc

SEQ ID NO: 66514 - DNA, 201 bp, Homo sapiens
caaatttgggacatactttttctgctgtaaaaatattttcctaaggccaggcgcagtggctcacgcctgtaatcctagcactttgggagacggaggcggcrgatcacttgaggccaggagttcaagaccagtctggccaacatggtgaaacccagtctctactaaaaatagaaaaaattagccaggcatggtggcacgtgc

SEQ ID NO: 66515 - DNA, 201 bp, Homo sapiens
cttgaacccaggaggcggaggttgcagtgagccgagatcacatcattccactccagcctgggtgccaagagcaaaaaactccatcttgaaaaataaagaaytttgtctccagtatcattcttgttctaggactgagaaacagttcattcttcattttcgtctactaaaatttaagttctttgattttcttctttaggtctt

SEQ ID NO: 66516 - DNA, 201 bp, Homo sapiens
tcagcctcccgggttcaagcaattctcctgcctcagcctcccgagtagttggaactataggcgtgagccaccatgccctgctaatttttgtatttttagtrcagatggggtttcactatgttggccaggctggtctcgaactcctgaccttgtgatctgcccacctcggcctcccaaagtgctgggattacaggtgtgagc

SEQ ID NO: 66517 - DNA, 201 bp, Homo sapiens
cctgcctcagcctcccaagtagctgggattacaggcatgtgccaccatgcccagctaatttttgcatttttagtacagcagggtttcaccatgttggtcargctggtctcaaactcctgacctcaggagatccgtcagccttggcctcccaaagtgttgggattacaggcgtgagccacagcacccagccagaatttaaac

SEQ ID NO: 66518 - DNA, 201 bp, Homo sapiens
gggttcaatcaatcctcctgcctcagcctcccaagtagctgggattacaggcatgtgccaccatgcccagctaatttttgcatttttagtacagcagggtktcaccatgttggtcaggctggtctcaaactcctgacctcaggagatccgtcagccttggcctcccaaagtgttgggattacaggcgtgagccacagcacc

SEQ ID NO: 66519 - DNA, 201 bp, Homo sapiens
ctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcctc

SEQ ID NO: 66520 - DNA, 201 bp, Homo sapiens
tctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcct

SEQ ID NO: 66521 - DNA, 201 bp, Homo sapiens
atctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcc

SEQ ID NO: 66522 - DNA, 201 bp, Homo sapiens
tggcggaaatgattggcggaaagaaagagccagttcacagtgcgcctttgtattcggcgggaaacccggccgaagagggagctggaaaggactccggaatscggccgtaattccagccaatcagggagtagagttgcggggcggggttggggcggggcagtctcgcgggagatagtttcgcgggttcgggaggcgagtctc

SEQ ID NO: 66523 - DNA, 201 bp, Homo sapiens
aaacaagatggggtcagttaagttagatctctttcactgtctcaggcataattttgcacaggcggtttcagtataatcatttcagtacaagacaagatttwaaaaaagaaaactaatgctaagcatttttcaagaaacatactgtaggccgggtgcagtggctcacgcctgtaattccagcaccttgggaggctgaggcgg

SEQ ID NO: 66524 - DNA, 201 bp, Homo sapiens
gcgaattcttcctgcctgatggccttcaaaatgggacatcagctctttttcctgcctttggactcaaaccattggctcttcctgggtcttgagcctgctgrcctttggactggagctacactatcagctctcttgattttcaggccttcaaacttagactcaaactacattattggctcccctgggtctcccagatcccag

SEQ ID NO: 66525 - DNA, 201 bp, Homo sapiens
ggcgggcggatcacgaggtcaggagatcgagaccatcctggctaacatggtgaaaccccgtctctactaaaaacacaaaaaaattagccgggtgtggtggygggcacctgtagtcccagctactcgggaggctgaggcaggagaatgggtcaacccaggaggcagagcttgcagtgagccaagatcctgccactgcactcc

SEQ ID NO: 66526 - DNA, 201 bp, Homo sapiens
atcgagaccatcctggctaacatggtgaaaccccgtctctactaaaaacacaaaaaaattagccgggtgtggtggtgggcacctgtagtcccagctactcrggaggctgaggcaggagaatgggtcaacccaggaggcagagcttgcagtgagccaagatcctgccactgcactccagcctgggtgacagagcgagactct

SEQ ID NO: 66527 - DNA, 201 bp, Homo sapiens
ttgggtaatgtgaatattaccctaaagaaagctgcatctatgtggaactgttaccgggaatgggtcccaatctagaccccaagagagggttcttggacctyacgcaagaaagaattaggggcaaatccataaagtgaaagcaagtttattgggaaagtaaaggaataaagaatggctactccataggtagagtcacagtat

SEQ ID NO: 66528 - DNA, 201 bp, Homo sapiens
agtatgggctgcttaactgagtatactcagttatttcttgattatatgctaaacaaggggtggattattcatcagttttctggaaaaggggcaggcatttstcggaactgagggttccttctttttttagactgtatagggtaacttcctgatgttgccatggtatttataaactgtcatggccctagtgggagagtcttt

SEQ ID NO: 66529 - DNA, 201 bp, Homo sapiens
ccagtagcagcaggcagctattcacacccaaatttcaccttaaaaagaatggcttcaaaattgacctcccccatgggaaatattgcaggacttaacacagrattgtttttctcttcatttctctacgatttctttctttctttttttttccttttttccgaggtggagtttctctctttttgcccaggctggagtgcactg

SEQ ID NO: 66530 - DNA, 201 bp, Homo sapiens
gtgagccaagatcgcgccattgcactcctgcctgggcaataagggcgaaactccatctcaaaaaaaagaaagaaatccttagactataagtttgttatatratctgcatgtaaaacaaggtcctatatgactcaaataatgtgcagggttccctttaaaaagttcagcaactactttcctttttttttttttgagatggag

SEQ ID NO: 66531 - DNA, 201 bp, Homo sapiens
ggaaattggtgcaaatgagaaatcttggaaatctgtaagtatatagatataaaagttattctttccagtttgattcttttatgatgtagattttaatatcmgtcaatttaggaaactctgtggctctgaattatagttataattctagttttactattacagtgaaagaagagaagaggctgttcattattatattggaag

SEQ ID NO: 66532 - DNA, 201 bp, Homo sapiens
gcgcccggcctatttcttcttctctttgtttagttattatctattactctcattcctatgaacataacttgtttctccccacttaatttttatcatacatrattgtagacagtgggcactgtcttcaattatagtgaatttagcagtaaattcacattagaccaacttgtatagctttaaaaaatatatttatgtctaggt

SEQ ID NO: 66533 - DNA, 201 bp, Homo sapiens
aggaggctgtgagagagaggatttgggaaattggtgcaaatgagaaatcttggaaatctgtaagtatatagatataaaagttattctttccagtttgattyttttatgatgtagattttaatatcagtcaatttaggaaactctgtggctctgaattatagttataattctagttttactattacagtgaaagaagagaag

SEQ ID NO: 66534 - DNA, 201 bp, Homo sapiens
gttgttgttttgagatggtgtcttgctctgtctcccaggctggagtgcaatggcgtgatctcagctcactgcaacctccgcctcccgggttcaagcgattytcctgcctcagcctcctgagtagctgggactacaggcgcctgccaccacgcccagctaatttttatacttttaatagagacagggtttcaccatattggc

SEQ ID NO: 66535 - DNA, 201 bp, Homo sapiens
gattacaggtgtgagccactgcgcccggcctatttcttcttctctttgtttagttattatctattactctcattcctatgaacataacttgtttctccccmcttaatttttatcatacataattgtagacagtgggcactgtcttcaattatagtgaatttagcagtaaattcacattagaccaacttgtatagctttaaa

SEQ ID NO: 66536 - DNA, 201 bp, Homo sapiens
gaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgatt

SEQ ID NO: 66537 - DNA, 201 bp, Homo sapiens
tgagatgtatgtattggagtacaatatttgacctagccaagaatttcacaaaagaagcccaaaatatgattttcacgtttactggactgttcacttttggkgggatcactttcttaagattacttaaagtactaatgcttgatgaaaatcatttgtgttttcacttcattaattggagaaagagctacatgtttttgttgt

SEQ ID NO: 66538 - DNA, 201 bp, Homo sapiens
ggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgat

SEQ ID NO: 66539 - DNA, 201 bp, Homo sapiens
tgcactccaacctaggcaacagagcaagaccctgtctcttaaaaggaaaggagagtccagtgtgttctaaggaaaaccccaagagcatcccaccttagaakacaagtgaggaggcctggcatggtgtctcatgcctgtaatcccagcactttgggaggccaaggtgggtggatcacttgaggtcaggagttctagaccagc

SEQ ID NO: 66540 - DNA, 201 bp, Homo sapiens
aggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatga

SEQ ID NO: 66541 - DNA, 201 bp, Homo sapiens
ctaacaatttgggaggccaaggcaggaggatcgcttgaggccaggagttcgagactagcctggggaacatagtgagaccctgtctctacaaaaaaaaaaaagaaaaaattagctgggtgtggtagtgcacacctgtggtcccagctactcaggaggccaagttgggaggattgcttgagcccaggaggtggaggctacagt

SEQ ID NO: 66542 - DNA, 201 bp, Homo sapiens
tcagctcccgaggttgaaggtggcaagaaggtggtaagaatcctagacaggctaggcctggtggctcacgcctataatcctaacaatttgggaggccaagrcaggaggatcgcttgaggccaggagttcgagactagcctggggaacatagtgagaccctgtctctacaaaaaaaaaaaagaaaaaattagctgggtgtgg

SEQ ID NO: 66543 - DNA, 201 bp, Homo sapiens
gaacctgggagacggaggttgcagtgagctgaggttgtgccattgcactccagcctgggagacagagcaagactccatctcaaaaaaaaaaaaaaaaaaawgtcactaatctctaagatctctgaataactctctcagaattagagtccatacagctctgatcttttcttcttttatgctgcttgtttttccaaggctttt

SEQ ID NO: 66544 - DNA, 201 bp, Homo sapiens
agaggcaggtggatcacctgaagtcaggagtttgagaccagcctggccaacatggcaaaaccccacctctactaaaaatacaaaaaaattagctgggcacrgtggcaggtgcctgtaatctcatctactagggaagctgaagcaggggaatcgcttgaacctgggagacggaggttgcagtgagctgaggttgtgccattg

SEQ ID NO: 66545 - DNA, 201 bp, Homo sapiens
tgggcaataagggcgaaactccatctcaaaaaaaagaaagaaatccttagactataagtttgttatataatctgcatgtaaaacaaggtcctatatgactyaaataatgtgcagggttccctttaaaaagttcagcaactactttcctttttttttttttgagatggagtctcactctgtcacccaggctggagtgggttg

SEQ ID NO: 66546 - DNA, 201 bp, Homo sapiens
agccactgcaccaggcccatttctctaccatttctgatctctctctagaaacacttggataactgcacagctcctttcataagaaatatattttagggccrggtgtggtggcttatgcctgtaatctcagcactttgggaggccgcggcaggtggatcaaccgaggtcaggagttcaagaccagcctggccaagatggtga

SEQ ID NO: 66547 - DNA, 201 bp, Homo sapiens
tctttctttttttttccttttttccgaggtggagtttctctctttttgcccaggctggagtgcactggtgcaatcttggctcaccacaacctctgtctccygggttcaagcaattctcctgcctcagcctcccgagtagctgggattacaggcatgcgccaccacgccaggctaattttgtatttttagtagagacggtgt

SEQ ID NO: 66548 - DNA, 201 bp, Homo sapiens
catctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgc

SEQ ID NO: 66549 - DNA, 201 bp, Homo sapiens
gtatgggagaccagagttttattattactcaaatcagtatccacaagcattccgccttcagaatttttaaggacaacatgttgggtgggaggaagccagtragctgggagtgctgattggtcagagctgaaatcatagggaatggaagctgtcttcttgagctgagtcaattcctgggtggggactgcaagatcagatgag

SEQ ID NO: 66550 - DNA, 201 bp, Homo sapiens
agtagagacggggtttcaccatgctggtcaggctggtcttgaactcctgacctcagaggatccacccgccttggccccacaaagtgctgggattccaggcrtgagccacagtgcctggccatgactaactcattccattgagggtcttttctcctgaagttttgtgctatgacttgatatttcaaaagaagggaaatagat

SEQ ID NO: 66551 - DNA, 201 bp, Homo sapiens
ctcccgagtagctgggattacaggcaccacctaattagcccgccaccacgcccggctaatttttgtatttttagtagagacggggtttcaccatcttggcyaggatggtcttgaactcctgacctcgtgatccacccgcctcggcctcccagagtgctgggattacaggcgtgagccaccgcacctggcctaaaactgatt

SEQ ID NO: 66552 - DNA, 201 bp, Homo sapiens
aatccggccgtaattccagccaatcagggagtagagttgcggggcggggttggggcggggcagtctcgcgggagatagtttcgcgggttcgggaggcgagwctccggtttccgcccagtctctggggacgcggtggcggggtctgaatcgcctggcttccagggagttttgggcgggtccccgcacgggagcgtggcaggc

SEQ ID NO: 66553 - DNA, 201 bp, Homo sapiens
ttcaaaatgggacatcagctctttttcctgcctttggactcaaaccattggctcttcctgggtcttgagcctgctggcctttggactggagctacactatyagctctcttgattttcaggccttcaaacttagactcaaactacattattggctcccctgggtctcccagatcccagcagatcttgggaattgccagcctt

SEQ ID NO: 66554 - DNA, 201 bp, Homo sapiens
aaatgctgggattacaggcgtgagccaccacgccaggccagaaacatatttttaaaaatcttgttttagaggaaaaacagagtatttctttttttttttttattagatggattctcactctattgcccaggctggagtacagtggcacaatcttggctcaccgcaacctcagcctcccgggttcaagcaattctcctgcct

SEQ ID NO: 66555 - DNA, 201 bp, Homo sapiens; identical to SEQ ID NO: 43876

SEQ ID NO: 66556 - DNA, 201 bp, Homo sapiens; identical to SEQ ID NO: 44244

SEQ ID NO: 66557 - DNA, 201 bp, Homo sapiens; identical to SEQ ID NO: 44247

SEQ ID NO: 66558 - DNA, 201 bp, Homo sapiens; identical to SEQ ID NO: 44100

SEQ ID NO: 66559 - DNA, 201 bp, Homo sapiens; identical to SEQ ID NO: 44107

SEQ ID NO: 66560 - DNA, 201 bp, Homo sapiens; identical to SEQ ID NO: 43963

SEQ ID NO: 66561 - DNA, 201 bp, Homo sapiens; identical to SEQ ID NO: 43964

SEQ ID NO: 66562 - DNA, 201 bp, Homo sapiens; identical to SEQ ID NO: 44167

SEQ ID NO: 66563 - DNA, 201 bp, Homo sapiens; identical to SEQ ID NO: 43966

SEQ ID NO: 66564 - DNA, 201 bp, Homo sapiens; identical to SEQ ID NO: 44168

SEQ ID NO: 66565 - DNA, 201 bp, Homo sapiens; identical to SEQ ID NO: 43968

SEQ ID NO: 66566 - DNA, 201 bp, Homo sapiens; identical to SEQ ID NO: 43969

SEQ ID NO: 66567 - DNA, 201 bp, Homo sapiens; identical to SEQ ID NO: 43971

SEQ ID NO: 66568 - DNA, 201 bp, Homo sapiens; identical to SEQ ID NO: 43973

SEQ ID NO: 66569 - DNA, 201 bp, Homo sapiens; identical to SEQ ID NO: 43976

SEQ ID NO: 66570 - DNA, 201 bp, Homo sapiens; identical to SEQ ID NO: 43979

SEQ ID NO: 66571 - DNA, 201 bp, Homo sapiens; identical to SEQ ID NO: 43982

SEQ ID NO: 66572 - DNA, 201 bp, Homo sapiens; identical to SEQ ID NO: 43990

SEQ ID NO: 66573 - DNA, 201 bp, Homo sapiens; identical to SEQ ID NO: 43994

SEQ ID NO: 66574 - DNA, 201 bp, Homo sapiens; identical to SEQ ID NO: 44192

SEQ ID NO: 66575 - DNA, 201 bp, Homo sapiens; identical to SEQ ID NO: 44112

SEQ ID NO: 66576 - DNA, 201 bp, Homo sapiens; identical to SEQ ID NO: 44076

SEQ ID NO: 66577 - DNA, 201 bp, Homo sapiens; identical to SEQ ID NO: 44113

SEQ ID NO: 66578 - DNA, 201 bp, Homo sapiens; identical to SEQ ID NO: 44114

SEQ ID NO: 66579 - DNA, 201 bp, Homo sapiens; identical to SEQ ID NO: 43892

SEQ ID NO: 66580 - DNA, 201 bp, Homo sapiens; identical to SEQ ID NO: 44115

SEQ ID NO: 66581 - DNA, 201 bp, Homo sapiens; identical to SEQ ID NO: 43893

SEQ ID NO: 66582 - DNA, 201 bp, Homo sapiens; identical to SEQ ID NO: 44116

SEQ ID NO: 66583 - DNA, 201 bp, Homo sapiens; identical to SEQ ID NO: 43896

SEQ ID NO: 66584 - DNA, 201 bp, Homo sapiens; identical to SEQ ID NO: 44290

SEQ ID NO: 66585 - DNA, 201 bp, Homo sapiens; identical to SEQ ID NO: 44120

SEQ ID NO: 66586 - DNA, 201 bp, Homo sapiens; identical to SEQ ID NO: 44121

SEQ ID NO: 66587 - DNA, 201 bp, Homo sapiens; identical to SEQ ID NO: 44122

SEQ ID NO: 66588 - DNA, 201 bp, Homo sapiens; identical to SEQ ID NO: 43996

SEQ ID NO: 66589 - DNA, 201 bp, Homo sapiens; identical to SEQ ID NO: 43998

SEQ ID NO: 66590 - DNA, 201 bp, Homo sapiens; identical to SEQ ID NO: 44124

SEQ ID NO: 66591 - DNA, 201 bp, Homo sapiens; identical to SEQ ID NO: 43999

SEQ ID NO: 66592 - DNA, 201 bp, Homo sapiens; identical to SEQ ID NO: 44000

SEQ ID NO: 66593 - DNA, 201 bp, Homo sapiens; identical to SEQ ID NO: 44078

SEQ ID NO: 66594 - DNA, 201 bp, Homo sapiens; identical to SEQ ID NO: 44002

SEQ ID NO: 66595 - DNA, 201 bp, Homo sapiens; identical to SEQ ID NO: 43912

SEQ ID NO: 66596 - DNA, 201 bp, Homo sapiens; identical to SEQ ID NO: 44003

SEQ ID NO: 66597 - DNA, 201 bp, Homo sapiens; identical to SEQ ID NO: 44004

SEQ ID NO: 66598 - DNA, 201 bp, Homo sapiens; identical to SEQ ID NO: 44006

SEQ ID NO: 66599 - DNA, 201 bp, Homo sapiens; identical to SEQ ID NO: 44008

SEQ ID NO: 66600 - DNA, 201 bp, Homo sapiens; identical to SEQ ID NO: 44010

SEQ ID NO: 66601 - DNA, 201 bp, Homo sapiens; identical to SEQ ID NO: 44203

SEQ ID NO: 66602 - DNA, 201 bp, Homo sapiens; identical to SEQ ID NO: 44212

SEQ ID NO: 66603 - DNA, 201 bp, Homo sapiens; identical to SEQ ID NO: 44213

SEQ ID NO: 66604 - DNA, 201 bp, Homo sapiens; identical to SEQ ID NO: 44082

SEQ ID NO: 66605 - DNA, 201 bp, Homo sapiens; identical to SEQ ID NO: 44083

SEQ ID NO: 66606 - DNA, 201 bp, Homo sapiens; identical to SEQ ID NO: 44302

SEQ ID NO: 66607 - DNA, 201 bp, Homo sapiens; identical to SEQ ID NO: 44304

SEQ ID NO: 66608 - DNA, 201 bp, Homo sapiens; identical to SEQ ID NO: 44306

SEQ ID NO: 66609 - DNA, 201 bp, Homo sapiens; identical to SEQ ID NO: 44308

SEQ ID NO: 66610 - DNA, 201 bp, Homo sapiens; identical to SEQ ID NO: 44135

SEQ ID NO: 66611 - DNA, 201 bp, Homo sapiens; identical to SEQ ID NO: 44136

SEQ ID NO: 66612 - DNA, 201 bp, Homo sapiens; identical to SEQ ID NO: 44137

SEQ ID NO: 66613 - DNA, 201 bp, Homo sapiens; identical to SEQ ID NO: 44138

SEQ ID NO: 66614 - DNA, 201 bp, Homo sapiens; identical to SEQ ID NO: 44018

SEQ ID NO: 66615 - DNA, 201 bp, Homo sapiens; identical to SEQ ID NO: 44139

SEQ ID NO: 66616 - DNA, 201 bp, Homo sapiens; identical to SEQ ID NO: 44021

SEQ ID NO: 66617 - DNA, 201 bp, Homo sapiens; identical to SEQ ID NO: 44023

SEQ ID NO: 66618 - DNA, 201 bp, Homo sapiens; identical to SEQ ID NO: 44141

SEQ ID NO: 66619 - DNA, 201 bp, Homo sapiens; identical to SEQ ID NO: 44025

SEQ ID NO: 66620 - DNA, 201 bp, Homo sapiens; identical to SEQ ID NO: 44027

SEQ ID NO: 66621 - DNA, 201 bp, Homo sapiens; identical to SEQ ID NO: 44029

SEQ ID NO: 66622 - DNA, 201 bp, Homo sapiens; identical to SEQ ID NO: 44031

SEQ ID NO: 66623 - DNA, 201 bp, Homo sapiens; identical to SEQ ID NO: 44219

SEQ ID NO: 66624 - DNA, 201 bp, Homo sapiens; identical to SEQ ID NO: 44032

SEQ ID NO: 66625 - DNA, 201 bp, Homo sapiens; identical to SEQ ID NO: 44220

SEQ ID NO: 66626 - DNA, 201 bp, Homo sapiens; identical to SEQ ID NO: 44035

SEQ ID NO: 66627 - DNA, 201 bp, Homo sapiens; identical to SEQ ID NO: 44037

SEQ ID NO: 66628 - DNA, 201 bp, Homo sapiens; identical to SEQ ID NO: 44039

SEQ ID NO: 66629 - DNA, 201 bp, Homo sapiens; identical to SEQ ID NO: 44223

SEQ ID NO: 66630 - DNA, 201 bp, Homo sapiens; identical to SEQ ID NO: 44225

SEQ ID NO: 66631 - DNA, 201 bp, Homo sapiens; identical to SEQ ID NO: 44228

SEQ ID NO: 66632 - DNA, 201 bp, Homo sapiens; identical to SEQ ID NO: 44312

SEQ ID NO: 66633 - DNA, 201 bp, Homo sapiens; identical to SEQ ID NO: 44313

SEQ ID NO: 66634 - DNA, 201 bp, Homo sapiens; identical to SEQ ID NO: 44090

SEQ ID NO: 66635 - DNA, 201 bp, Homo sapiens; identical to SEQ ID NO: 44321

SEQ ID NO: 66636 - DNA, 201 bp, Homo sapiens; identical to SEQ ID NO: 44239

SEQ ID NO: 66637 - DNA, 201 bp, Homo sapiens; identical to SEQ ID NO: 44148

SEQ ID NO: 66638 - DNA, 201 bp, Homo sapiens; identical to SEQ ID NO: 44240

SEQ ID NO: 66639 - DNA, 201 bp, Homo sapiens; identical to SEQ ID NO: 44047

SEQ ID NO: 66640 - DNA, 201 bp, Homo sapiens; identical to SEQ ID NO: 44149

SEQ ID NO: 66641 - DNA, 201 bp, Homo sapiens; identical to SEQ ID NO: 44150

SEQ ID NO: 66642 - DNA, 201 bp, Homo sapiens; identical to SEQ ID NO: 44151

SEQ ID NO: 66643 - DNA, 201 bp, Homo sapiens; identical to SEQ ID NO: 44048

SEQ ID NO: 66644 - DNA, 201 bp, Homo sapiens; identical to SEQ ID NO: 44152

SEQ ID NO: 66645 - DNA, 201 bp, Homo sapiens; identical to SEQ ID NO: 44154

SEQ ID NO: 66646 - DNA, 201 bp, Homo sapiens; identical to SEQ ID NO: 44155

SEQ ID NO: 66647 - DNA, 201 bp, Homo sapiens; identical to SEQ ID NO: 44049

SEQ ID NO: 66648 - DNA, 201 bp, Homo sapiens; identical to SEQ ID NO: 43955

SEQ ID NO: 66649 - DNA, 201 bp, Homo sapiens; identical to SEQ ID NO: 44158

SEQ ID NO: 66650 - DNA, 201 bp, Homo sapiens
ctgtagataaggttgaagttccctaggatggcctcttctcgtcagacacacagcaccctggaagcctggtcttcctgccctctccgtggaggctgctatgyattcacatgtgattttcccttgccagattctgagcatcctgaggggaaggactggttttgtcttttcagtcttgcgcagtacctgaaaaagtaccctttc

SEQ ID NO: 66651 - DNA, 201 bp, Homo sapiens
cagtggcacaatctcagctcactgcaagctccatatcccaagttcacgccattctcctgcctcagcctctcaagtagctgggactacaggcacctgccacsaagcctggctaattttttgtatttttggtagagacagggtttcaccgtgttaaccaggatggtgtcgatcccctgacctcacgatccacccacctcagcc

SEQ ID NO: 66652 - DNA, 201 bp, Homo sapiens
acattttttttttttttgagatggagtctcgttctgtcacccaggctggagtgcagtggcacaatctcagctcactgcaagctccatatcccaagttcacrccattctcctgcctcagcctctcaagtagctgggactacaggcacctgccaccaagcctggctaattttttgtatttttggtagagacagggtttcaccg

SEQ ID NO: 66653 - DNA, 201 bp, Homo sapiens
atgatcagaagactcttctttaggacttgtcttttatctgtgttcccagtaaaatcctacttttcttgcagatcctatcacttcatggattgtcataaaayttggtattcattaatcagtttgtcacagcaaataattcttcccagcaagactgcaggctgaaggtgtactgtctagaaacatccagttttgttgagtcaa

SEQ ID NO: 66654 - DNA, 201 bp, Homo sapiens
caccaggaggtatggctgtctctcttgtttgtgttgatagcatcctctgatgctcaatttgtagattcattaaatcattatgggttggaatatgatgataytttaattcttttatttctttaaaatgttatagctaggatacttttatgatatttccctcacttactatttagtgatcttatggtgaaaagccactggttt

SEQ ID NO: 66655 - DNA, 201 bp, Homo sapiens
tcttcaccaggcacatgaaatgtatttccccagttgttccataggtgatatagtttctacatattgcataattcttcttagtttgtccttgccttgtgggyactacttcacagagtatcagacccagtgcacgtggcatctgaccttgtggtggaacatggacacctaacataatctgacctattaagtaattactcattt

SEQ ID NO: 66656 - DNA, 201 bp, Homo sapiens
cattagaaaccaagatgtgagtggtagatgtgctcattaccactgaggtgtcattgcttccaggccctctccactgacagaggaaggaaatgtatgtatayattctaacctgtgcatataaacatatctataaatattcctacatgtaaccatctctatctatattaagctatacatgagttcatatggatgtctccaact

SEQ ID NO: 66657 - DNA, 201 bp, Homo sapiens
ctattttattgtgagcaaagccaatttctttgaacctcacttttcttatctgtcaaatgggaacattaatatagttcataagtttggcgttaatgtagttmataagtttgaagcattctattattttcctgtttgaacttcagtgcctagcataatcacataaaagaagaatcttataattgtgaagttgacatcatcaaa

SEQ ID NO: 66658 - DNA, 201 bp, Homo sapiens
ttagttgtgtgcttattgcctgccaaagttaaggactccttgtctcatctctgttctgtcctcacctggccccacttatccttttatatctcagttgtgarcatgaactaatcaagagctagattaactggatttgaatcccagctctaacacctatgcaaccttggacaaaatctttaagctttctatgtctcagtttcc

SEQ ID NO: 66659 - DNA, 201 bp, Homo sapiens
tttccttgagtcatgtggtcagaatgaatcactaattttgatgcaaagcagtctagtaactaaaagcacagacttggtctctgggttcaaatttcagctcrgatattacacagacatgtgacctgggataaatcctcatctacgaatgggaattggaatgctgcctcactcatcagttatttttgaggctttttgagacaa

SEQ ID NO: 66660 - DNA, 201 bp, Homo sapiens
taaattcaggttatctatatctctaatgatttcctgcctacatgatgtattaattactgacagagggatgttgaagtctccaactataatagtgggtttayttatttttcttttcaattctatctgtttttgccttatgtagtttgacattctcttgttaggcacataaatgttcatattgctcgttcttcttagagaatt

SEQ ID NO: 66661 - DNA, 201 bp, Homo sapiens
acccatgcaatgcatagcacaggctaggtggtctgtggctagactgtcaatgggcaagtcccatgtttgttcagggtgctgtactctggctcttctagaakaatcttccctggtcacagaaatcaacctcaggcatgctgttcctcccttagatgtgaatgctattaaataaaacacactagaaactatctgtagtatgca

SEQ ID NO: 66662 - DNA, 201 bp, Homo sapiens
agacaagagcagtggctatggcatcatggtaggctcagattccagtccctctctgacagtttgactttggaaaagcttcatagtagtttctccatgtcacstttcaccaagtataaaatgaagctcataataacatctactttttattactgtttttgtcagttgatttatgcagacagcttagaaatagtgcctggtact

SEQ ID NO: 66663 - DNA, 201 bp, Homo sapiens
agaggcagcatagtcaacagacaagagcagtggctatggcatcatggtaggctcagattccagtccctctctgacagtttgactttggaaaagcttcatartagtttctccatgtcacctttcaccaagtataaaatgaagctcataataacatctactttttattactgtttttgtcagttgatttatgcagacagctta

SEQ ID NO: 66664 - DNA, 201 bp, Homo sapiens
gagctgtcagatgacttgacagtaatatctgaataacttatttgtaccagaaactaccttgaaaagatcacataaaggaagacagactgctttggaaaaamatattcaaaaagaaaaataaagtagggtgaggatcttcttgaaaattttattgagttggccttattgcaatcctttcctcttgtcttgatgactttgaca

SEQ ID NO: 66665 - DNA, 201 bp, Homo sapiens
atcaaatactatgagctgtcagatgacttgacagtaatatctgaataacttatttgtaccagaaactaccttgaaaagatcacataaaggaagacagactrctttggaaaaaaatattcaaaaagaaaaataaagtagggtgaggatcttcttgaaaattttattgagttggccttattgcaatcctttcctcttgtcttg

SEQ ID NO: 66666 - DNA, 201 bp, Homo sapiens
ctgatcaaatactatgagctgtcagatgacttgacagtaatatctgaataacttatttgtaccagaaactaccttgaaaagatcacataaaggaagacagmctgctttggaaaaaaatattcaaaaagaaaaataaagtagggtgaggatcttcttgaaaattttattgagttggccttattgcaatcctttcctcttgtc

SEQ ID NO: 66667 - DNA, 201 bp, Homo sapiens
aaagacaaaacctcaaacaggggtccatttctgacagcaaataaagagggtcaacacgaaatttggggacaccagtaaacaaatggtatattaacatataacattatgatatatgcaatataatattatgaacatttccagtctttatggcttctatcaagttttcaaattggaacaagcaactttgcagctgaataaaaa

SEQ ID NO: 66668 - DNA, 201 bp, Homo sapiens
ggaaagacaaaacctcaaacaggggtccatttctgacagcaaataaagagggtcaacacgaaatttggggacaccagtaaacaaatggtatattaacatataacattatgatatatgcaatataatattatgaacatttccagtctttatggcttctatcaagttttcaaattggaacaagcaactttgcagctgaataaa

SEQ ID NO: 66669 - DNA, 201 bp, Homo sapiens
gagctgctgaaagggaaagacaaaacctcaaacaggggtccatttctgacagcaaataaagagggtcaacacgaaatttggggacaccagtaaacaaatgktatattaacatataacattatgatatatgcaatataatattatgaacatttccagtctttatggcttctatcaagttttcaaattggaacaagcaacttt

SEQ ID NO: 66670 - DNA, 201 bp, Homo sapiens
gttgttttccaattttgtctcaagaaattttaaaattttcctttaagttccttcattgatccattggttgtccaggagcatgttgtttaatttcaatgtakttgtgaattttgtgaagttcctcctgttattaatttctagtgttatacccttgtggtcagaaaatatactttatatgatttgaatcttcttaaatttgtt

SEQ ID NO: 66671 - DNA, 201 bp, Homo sapiens
ttgtattactgactcaatctccttacttgctattggtctattaagattttctatttcttcataattcagttctggtagattgcatgcatcaaatgaatttrttcattttattttatttgtttttttcttaattagtccagcaataggtctttcaactttatcttttcaaaaaaaatcaactcttggttttgtttatttttt

SEQ ID NO: 66672 - DNA, 201 bp, Homo sapiens
tatttcagtgatgcaatttatgatatacagaaagggaatgtgttaaaaatttaagcctatgtaaatcttggttagaatgaaagtaaagcatatgggcaaasaatggacattagaaacagcctaaaaattagtttaataaaatgccaccgctatattttcctgattgatgaatggatcctcatcacaatgcaatgcaaaata

SEQ ID NO: 66673 - DNA, 201 bp, Homo sapiens
atgagtggatagacgaaaggtcaagtgcctttataagaagattgtcgaacacatggacacagggtggggaacatcacacaccggggcctgttgtggggtcrggggagtggggagggatagcatttggagatatacctaatgtaaatgacgagttaatgggtgcagcacaccaacatggcacatgtatacatatgtaactaa

SEQ ID NO: 66674 - DNA, 201 bp, Homo sapiens
gactcactggctactgcttccttgctattttcagagtaaggctatcttgttcataggtgcatgatcagatttcttgggtatatttcagtgatgcaatttawgatatacagaaagggaatgtgttaaaaatttaagcctatgtaaatcttggttagaatgaaagtaaagcatatgggcaaacaatggacattagaaacagcc

SEQ ID NO: 66675 - DNA, 201 bp, Homo sapiens
gcatggttcagagttctagaaagagcatgggttgtttatttatttttttaactctatagagctttctctttggttgctttcatgcagtgtttcaaaacatsatagctagaattccttcccactttaacctgtatagcccttattgtaagtgattttgatttcactcacacagttcctttcaggcctttatcatgagaggga

SEQ ID NO: 66676 - DNA, 201 bp, Homo sapiens
catacatgtggcttttgccattcttaacagctagcatgactcattgttcaagcctttgtttccaggaaaaaaaaaaaaacctttggttcttggtttaaaakgctactgtgcaaacagctcagtaaaaggcaaatgacagggaaaaaggtttccctcatactcgtacttttgattgacttgactcttgcccactttgcattt

SEQ ID NO: 66677 - DNA, 201 bp, Homo sapiens
gatagacgaaaggtcaagtgcctttataagaagattgtcgaacacatggacacagggtggggaacatcacacaccggggcctgttgtggggtcaggggagkggggagggatagcatttggagatatacctaatgtaaatgacgagttaatgggtgcagcacaccaacatggcacatgtatacatatgtaactaacctgcac

SEQ ID NO: 66678 - DNA, 201 bp, Homo sapiens
aatatcctcactttgtagataaagaaactgagggtttgaataactgagtaactcaaccacaccttcacagattgcaaatagagaatccagtgagttttgcwctagaatgcagggactcactggctactgcttccttgctattttcagagtaaggctatcttgttcataggtgcatgatcagatttcttgggtatatttcag

SEQ ID NO: 66679 - DNA, 201 bp, Homo sapiens
gtgtgttctccatgagccagttgtggaaggaggttaaggtcactagtgaaagcactttattctttattagctcctggacaaggcagatgtggtagtctttrgatttagctatagtagttgtgactgaggtctcacagtgtgggccaactcattgctgatatggaaaagacctagcgagaacgccaggctcagcaatctcaa

SEQ ID NO: 66680 - DNA, 201 bp, Homo sapiens
agtagttgtgactgaggtctcacagtgtgggccaactcattgctgatatggaaaagacctagcgagaacgccaggctcagcaatctcaaggcacagctgtrcagcttctgtctttcatgctgagatgtcctaacctttcccaaagactctgcttattttcagtttcaggctggaatcttcattcagaagtaggtagggcca

SEQ ID NO: 66681 - DNA, 201 bp, Homo sapiens
cagtagtttccccaacctattctgggagcacgcttccattacccctgtggcagcatgtttctgtgcctaacttggaagcctctgtacctctattttaaacytgatgcctgcagcctttgggttgtggaaaaggcagaggttccacctttcagttcttatgaacttcctatgtcctacaagacacaggaaaaacagtgagcc

SEQ ID NO: 66682 - DNA, 201 bp, Homo sapiens
tgaagggatctgtgacatcctttgattgacttttgttccttggtgtcctgaaatttcagtctatgatgaagaaaataaaacaatgacaaggcaggtgcccygactctggctgataccacactaggcacttactcatttgctactcattggaaccccacaacctcactcttggcctttcaactaatattggtaaactggagc

SEQ ID NO: 66683 - DNA, 201 bp, Homo sapiens
cattctagattttgtcccttagagctggcctaaggaatccagccaggttaacttgggtcaagtggggtctgacaatgattccctcctgcctgagaagcttrcctgactctattccaccaatctattagctaatcctagatgcttgcctctgatattattctttgagctccttaaaaagaagattctcatctcagtttggga

SEQ ID NO: 66684 - DNA, 201 bp, Homo sapiens
tgccaggattcacatgggactcacaagtaggggagagagaaactgaaacattggtggtttgttcatagggccacagggtaggtgtgaattgaaatatctcytagcactgaattagctgggttgaaatgtcattggctgtagttggtgagatgaccactatcccattgactgaatgaccttgggttggcaacctggagaatt

SEQ ID NO: 66685 - DNA, 201 bp, Homo sapiens
gagaaaaggctttagaatcataaatattgtatgtatttaaaaaattctaagacatatattcttaataaaaatgttcaattttccttaaaatgtacaccttracatctctgaaatcagcatgcaccttattatcaggggaatcctaaaatcttgagttctttccagggaggtttgcaattgcttctgtggtcaccaggtggc

SEQ ID NO: 66686 - DNA, 201 bp, Homo sapiens
cacacgaaatggtacttgatatcatttgactacctagagggtggtagaaacagctgtaattttgcaagataatatcaagacaataaaggagtcttataagkctactgtctcattaagggatggatttcttcccgaagcctctttgaaacctgtccttcacatctgaaggaggaggccaagatattcatactatgttgggac

SEQ ID NO: 66687 - DNA, 201 bp, Homo sapiens
gattgcaaaggaacaattatttttccatttccatttttcctttcagaaaacatacttttatggtccagacttgttcccaagaagaaaggtagggcagtggsaagagaaaaggctttagaatcataaatattgtatgtatttaaaaaattctaagacatatattcttaataaaaatgttcaattttccttaaaatgtacacc

SEQ ID NO: 66688 - DNA, 201 bp, Homo sapiens
tctttgatttatttcatcagtgttttgaagatttcttgtacaaattttgttaaatttatatttaagtatttcatttttggtgctattgtaaataatattgtttctttaatttcaaatttcaacgttagatggctgatataaaggaaaacaattgacttttgtatattgacattgtattctgtgacttatttgtttattagt

SEQ ID NO: 66689 - DNA, 201 bp, Homo sapiens
ctttgatttatttcatcagtgttttgaagatttcttgtacaaattttgttaaatttatatttaagtatttcatttttggtgctattgtaaataatattgtttctttaatttcaaatttcaacgttagatggctgatataaaggaaaacaattgacttttgtatattgacattgtattctgtgacttatttgtttattagtc

SEQ ID NO: 66690 - DNA, 201 bp, Homo sapiens
tgtgctttgcctggcattaaatgcctcacctcttgcttcagttcaacctactcctgggtcatggctttagacacagatgtactctcctggttctcttgagrtgtgatgtgggcaagtggtccgctgtggcttctctccaggttcaaccacaattccccgtgattgggcagagttctcaggataagaagactgagacctcac

SEQ ID NO: 66691 - DNA, 201 bp, Homo sapiens
gcatccaattttatcagtaccattagttaaaaagaatatcctttctccatggaattttcttaacatctttgctacaaatcaattgattatatttgtgtggstgtattttggggcttttctttctgttctattgagcgatgtgtttattctttctttagcatcatactgtagctttatagtaagttttgaaatcaggtagta

SEQ ID NO: 66692 - DNA, 201 bp, Homo sapiens
tggaaattcctagtctctttgccctgtgctggaatggtaatccagctgtcttcgaagaggcttggatgcatgcagaattactctggatccactttgatcaycaagctggccagcccagcctaatgtagtctggggcggtagcctaatgtagggcaggaaagcttggccagataatgcttaaaattctattaagagatggcg

SEQ ID NO: 66693 - DNA, 201 bp, Homo sapiens
atccttacccggagggtgtaagcccagtttattagtgtgtgtgtgtatgtgtgtgtgtttcctcttagaaacccatattgaggtttttttttttttttttycctttctgagagctgcatagaaaatacagcatctcacagttgatgacaccttagagtcaatgaaatatagtagctggattttgagatctaagatctccac

SEQ ID NO: 66694 - DNA, 201 bp, Homo sapiens
actattgtcaggccttctgaataaggcctccaagctttcattctctggctctgtcacttcaaagctcattttctgacactcctctaatatagctctcctaygctctctccagctattcaagtaattggcaattctccagattcaacgtactatttggtgcttactaacaatctcctactgtccaattctgctcaaaagtca

SEQ ID NO: 66695 - DNA, 201 bp, Homo sapiens
tctgacactcctctaatatagctctcctatgctctctccagctattcaagtaattggcaattctccagattcaacgtactatttggtgcttactaacaatytcctactgtccaattctgctcaaaagtcatcttcctaagtttactttagtgttcatttgaatgaaagaatgcttaatattttgattggcttttggaatgc

SEQ ID NO: 66696 - DNA, 201 bp, Homo sapiens
aagtatttatgcaataccatgaattatataaaagtcctgtttcacataatgttgtggataggcacgccaattattataggcaaacgtgaccagggaatgtstgaatgatatttctgtacatttcgatggagctttgttcatttcggtgtttgaacatttcagtgttttcataaaggtggaaaggcaaacgggttcctatat

SEQ ID NO: 66697 - DNA, 201 bp, Homo sapiens
tgcaagatgttaaaaataaatgtgtgaaagatgttttcactctcttgagaaatgtgctgaataaatacaaaatattcccaagatgcattttgttaatacayatgaactcaataatattgacctgggagaataacagatcgtttgaccttccatgaaatggaagtccccatccgctttctcagatgaatctgagttaagact

SEQ ID NO: 66698 - DNA, 201 bp, Homo sapiens
tacacacatacactaatgcacacatacatgtggcttttgccattcttaacagctagcatgactcattgttcaagcctttgtttccaggaaaaaaaaaaaaacctttggttcttggtttaaaaggctactgtgcaaacagctcagtaaaaggcaaatgacagggaaaaaggtttccctcatactcgtacttttgattgactt

SEQ ID NO: 66699 - DNA, 201 bp, Homo sapiens
tgtgcagggtgccaccactagaccaccccatatgtaatttccccctgtaaaccctatgtcttatttgctgtctctaggtctcatcttcagcctgagacacmgtaccatccctactggatgcaataggggtccagcactacacagctccaattttctcattggtaaagtaggagcccacttccagaccttccattagttagg

SEQ ID NO: 66700 - DNA, 201 bp, Homo sapiens
cagcagtaagtctctcactagatatggtccctcagccttggacttctcagcctctagaactataagaaataaattccctttcttttttttttttttttttwaattgatcattcttgggtgtttctcacagagggggatttggcagggtcacaggacaatagtggagggaaggtcagcagataaacaagtgaacaaaggtct

SEQ ID NO: 66701 - DNA, 201 bp, Homo sapiens
taaatgcatgagcatttttcatgccattgaatattaatgtaaaccatgatgtttaatggttatccatttttctttttcttttcttttttttttttttttttgagacagagttttgctcttattgccccggctagggtagtgcaatggcatgatcttggctcaccacaacctctgcctcccgggttccagcaattctcctgc

SEQ ID NO: 66702 - DNA, 201 bp, Homo sapiens
cattgtccctaacccaaagatgactaataatagctcctattatgcactataaataaaacagagttaatcctcacaacaaccctctaaggtgggttgttttwtatctccatttcaccggtgagaagtagttgttagtttggtggattcccaatcttaaagacacaactcttacaaaatttcaaagaacaacaagcattaaga

SEQ ID NO: 66703 - DNA, 201 bp, Homo sapiens
taactagcctccacaattttgtgaaccaatttcttaaaacaaatttttataagtaatacacaccctgttggttctgtttctccagagaaccctaacacaaacaccttcctgtcatctctacctgtcaatacttttcctttttgaaataacattttcttttctagttctattagttatacatgattattcccaaatattaaa

SEQ ID NO: 66704 - DNA, 201 bp, Homo sapiens
acagaggagctagctaacagtaacaacctgggctggatgtcaccctcaccaactctgaatctgtgatctttccctgaaaacagaggtgaaagcactttggmaaaaatctaagtggggacaggagctaatagtcattgagcatgtactatgtgccaggcaatgtactaaatgcattacacctatctcagtcttcaggaccac

SEQ ID NO: 66705 - DNA, 201 bp, Homo sapiens
ttattactcgtctgaggcagacattggataatgatgtgatgatgttcacgtccagggtttgttattcttccaacaaaatgtggagctggtagcctccttgraactctttggatcccaaatacatggttgtatatacgcatatatattatataaaattattttatacaaaaaaataaaatgtatgtaatatatataatacat

SEQ ID NO: 66706 - DNA, 201 bp, Homo sapiens
tggattagtccttatggtgtggccttccacattattatccccatttcctcaggaagaaactgagattcagcatgtttaaaattcttggaagcagggcctggtgcagtggcatttgcctataatcccggctacttggaaggctgaggtgggaagatcccctgagcccaggatttccaggctgcagtgagctatgattgcacc

SEQ ID NO: 66707 - DNA, 201 bp, Homo sapiens
ttccacgataaccctatataaatgttacctactgtcaatcaattaattatacttattttatttctatactttcatctatgtgaagcttgccttttcaatgktgttgccttgcaggatgctgtcttctattcctctgtacagtattgtaccttgcactcagcggtgaccccaaaagtgttgactgatttttccaccatgtta

SEQ ID NO: 66708 - DNA, 201 bp, Homo sapiens
taaaaaatgtgacataatcatcatttgtccagactaaagttgcgtaagatattatattttcaattttcttcagatggcaaattgggtggagacaaagtacrgagacgtactttgcttttagatttgtcactattttattgtgagcaaagccaatttctttgaacctcacttttcttatctgtcaaatgggaacattaatat

SEQ ID NO: 66709 - DNA, 201 bp, Homo sapiens
gtcatcaaatggcagcctgtgagaggtgacataggaccttgcagatcctcttgccaaaccttcagatatcgatgagcctcagagagacttgctcatttgcygccaagccagatctgctgactccaggaccacagctggagtcaggagctttgacctctgtgaagccatccagcccaccccataaggattctccctatggtg

SEQ ID NO: 66710 - DNA, 201 bp, Homo sapiens
ttcagtcaggtcaagaaataataaaatcagtccaatctgttgttggtatggtgtttgcaataaacagttacatgatttttattcttttctgacttcttggkgtggtctgggttttagactgaaccccacttcttagtgtcatagctaaggtttggagaatatcctgtagttgttgagctctctggatgaagcacaatgctg

SEQ ID NO: 66711 - DNA, 201 bp, Homo sapiens
gaactgaggcctacgtatcttgcctataatcatgaagagctagaatttgaaccaggaagcctggctctggcatccatcctctttattgctcagctatgctmtttttgaagaaagaaaagtcattgctatgacaggtgggaagtggacaggctcttagatcacttggtttaacacattccctttatgaatccataagcccaa

SEQ ID NO: 66712 - DNA, 201 bp, Homo sapiens
ccccaaaaatgatcatctccaactgagtagattccacattttcgtgtgacctttcatttaatggtggtggagagacttggggtcttatggcttgcattttktttttttagcattactcatagaaagacagccaaatatgccaggatctgctccttaaacttgataaagattgctaaattttttacttcgctaatatgtccc

SEQ ID NO: 66713 - DNA, 201 bp, Homo sapiens
agacagtgtttatcactgaccgcttacatcaagttattgggtgccctcatttattatgttaaaatggttgcagctgatgtgaattcatctaaaagcaaagktaagtggctgttaatgccacttggcttaataatctgaaagtggaagaaactcttgatgcttactgagttaaaggagtctttgttctttgagtcttctttt

SEQ ID NO: 66714 - DNA, 201 bp, Homo sapiens
gtggtgatagctgccatccttgaacactttacctaatcaaggtgttgccctgaagactttcatattaactgtgaggtaggtgcattcattatcctcatcayacagaggggaactcacgctcagagaggttactttacttatctaagttcacatagcaagaaagtggcagaggtggaattcaaatttgactctgaatccaca

SEQ ID NO: 66715 - DNA, 201 bp, Homo sapiens
ttttaaatgttcctttggagattcgaatgtgcagccaagtctaaggaccaatgctgtgcagggcagagacccgaacacctcagtgttattccacatccttrttgcctctgatgcattttactagattttggaagctaatagttgtatgatgtttcagtgtctggtctccttccaaataattgcttcctagatctaaccctg

SEQ ID NO: 66716 - DNA, 201 bp, Homo sapiens
tggctttatgtcttcctatatcatctcagtataagatgcccaatggagtggacacaaacagaatccaaaccaagcatactgaatgctctgagctgttcctratggacttcccaagaatcaatagcatgaatgctctgagctctgctggaggcacttcccaagaatcactagagtgaacactctgagccatgcctgatggac

SEQ ID NO: 66717 - DNA, 201 bp, Homo sapiens
cccaagaagaaaggtagggcagtgggaagagaaaaggctttagaatcataaatattgtatgtatttaaaaaattctaagacatatattcttaataaaaatrttcaattttccttaaaatgtacaccttgacatctctgaaatcagcatgcaccttattatcaggggaatcctaaaatcttgagttctttccagggaggttt

SEQ ID NO: 66718 - DNA, 201 bp, Homo sapiens
ccatctttaggcagaattggaagtttccgactattgtctggatgctaactttgatagggatgaagggatctgtgacatcctttgattgacttttgttcctyggtgtcctgaaatttcagtctatgatgaagaaaataaaacaatgacaaggcaggtgccccgactctggctgataccacactaggcacttactcatttgct

SEQ ID NO: 66719 - DNA, 201 bp, Homo sapiens
tttgatttatttcatcagtgttttgaagatttcttgtacaaattttgttaaatttatatttaagtatttcatttttggtgctattgtaaataatattgtttctttaatttcaaatttcaacgttagatggctgatataaaggaaaacaattgacttttgtatattgacattgtattctgtgacttatttgtttattagtct

SEQ ID NO: 66720 - DNA, 201 bp, Homo sapiens
ttgatttatttcatcagtgttttgaagatttcttgtacaaattttgttaaatttatatttaagtatttcatttttggtgctattgtaaataatattgtttctttaatttcaaatttcaacgttagatggctgatataaaggaaaacaattgacttttgtatattgacattgtattctgtgacttatttgtttattagtctt

SEQ ID NO: 66721 - DNA, 201 bp, Homo sapiens
agcttaagagtcactttcttcaagaagtcttctctcatctaaaggtcatgtgttacctctgtgtttccatggcccccagacttaccttcctcataacacayggcacattttacattccttacctattaatgaatacctaactagacttaattccaggaagggaggaggtgtgttttcatcattctcatattcctaacacat

SEQ ID NO: 66722 - DNA, 201 bp, Homo sapiens
aactgagtctttattcatttccttattcattcaacaagtatttatgcaataccatgaattatataaaagtcctgtttcacataatgttgtggataggcacrccaattattataggcaaacgtgaccagggaatgtgtgaatgatatttctgtacatttcgatggagctttgttcatttcggtgtttgaacatttcagtgtt

SEQ ID NO: 66723 - DNA, 201 bp, Homo sapiens
aagttcccttctgctgctagttttctgagagtttttaacataaatggacgttgaagtttatccaatgcatttatttggcaattgataagatcatatgattktccttctttaacttactaatatagttaaccactattgtttgattttagaatgttgaataaactttatatacctgggagaagttctgttggagcatggcgt

SEQ ID NO: 66724 - DNA, 201 bp, Homo sapiens
gattcatctgggaaatgtgggaagagctgaagaaggcctttggcaactgcaataggtctcctctcccctatccagagttctgcttagaaagtcctgatgaytggctgggtagtgaaggaagatgttgagtcactaattctaacctggctgaggcccaagccttgggtcacatgacttgttacatatcatccacactgggtg

SEQ ID NO: 66725 - DNA, 201 bp, Homo sapiens
ttttcattttcatttagttcaattttgttttgttttgttttgtttttttagaccgagtctcactctcccaggctgaattgcagcggcgcaatcttggctcwctgcaagctccgcctcccaggttcacgccattctcctgcctcagcctcccaagtagttgggactacagacgccggccaccacgcctggctaattttttgt

SEQ ID NO: 66726 - DNA, 201 bp, Homo sapiens
gtcttattttagcaccctgcagcctcgcagtgggcaggagacgccccgccgccccgagctgagttcatcttcccgaaacccccggagccgcgggcatctcrccacgctgctctgagaatagcccgggagcaacagggccggcggctggtttctgcatcaattctcctccccctagtagcggctctgaaaacgcggagacac

SEQ ID NO: 66727 - DNA, 201 bp, Homo sapiens
gcattcttcttttaataagaaaatatccaataagaaatattcaataaggaaataccaatgtgattggtagcatctgacagacacattaagttttctacatmtctttaccatagttctgatttgtgcttgcccatgagatctgtaagcccacttaggaaatatctagcctgactaaagaagggcaaatgattcatctgggaa

SEQ ID NO: 66728 - DNA, 201 bp, Homo sapiens
acccccggagccgcgggcatctcgccacgctgctctgagaatagcccgggagcaacagggccggcggctggtttctgcatcaattctcctccccctagtarcggctctgaaaacgcggagacacggagagcagaaaacgaaattttaatgtactgtggcgtgaacttctggaaaagggtctccagcacaagaactcagttc

SEQ ID NO: 66729 - DNA, 201 bp, Homo sapiens
atttgctttcttaatttggctcacagcacttctcagtgcatatctgttggctgtattgagatccttttgttccccggtgtgacatgcccagtacttctttstgctttctcccatacaggtactgatatcacacagattttggggctattgggggattgttgctacccacttctatattggaatgtatgggtctatcaccct

SEQ ID NO: 66730 - DNA, 201 bp, Homo sapiens
ccagcacaagaactcagttcaatgacttaaaataaatgggcggggttggaggggtgggggcagaagaaactagctgcttaagagtaacgggagcactgaaraaggattcctgcagaaagcgagccgccgaacatgctgtttattgcacttaaggcacctgagcatgttggtgtggacgcgctggcttgttgaattttcctt

SEQ ID NO: 66731 - DNA, 201 bp, Homo sapiens
gatctcagttcactgcaacctctgcctcccaggttcaagcgattcttgtgcctcagcctcccgagtagctgggattacaggtgtgtgccaccacacctggmtaatatttgtatttttagtaggggcagggttttgccatgttggccaggctggtcttgaactcctgacctcaagtgatccacccgcctcattctcccaaaa

SEQ ID NO: 66732 - DNA, 201 bp, Homo sapiens
tcttttctttttttttttttttgagacggagtttcgctctgtcgcccaggctggagtgcaatggagctgcaacctctgcctcccgggttcacgctattctyctgcctcagccttgatggtctcgatctcctgacctcgtgatcctcccgcctcggccttgcaaagtgctgggattacaggtgtgagccaccacgcccgtcc

SEQ ID NO: 66733 - DNA, 201 bp, Homo sapiens
acctggctaatatttgtatttttagtaggggcagggttttgccatgttggccaggctggtcttgaactcctgacctcaagtgatccacccgcctcattctyccaaaatgctaggattacaggcataagtgaccactcccggccgggtttgattgttctgggaggctatttctggctttgtcttctcttgagccatcttgtc

SEQ ID NO: 66734 - DNA, 201 bp, Homo sapiens
ccccagccatgtgtaactgtaagtccaataaacctctttcttttgtaaattgccccatcttaggtatgtctttttcagcagcatgaaaatggactaatacrgttgtgtacataagtctatagattcacactcatgtaagaccagaatgacagatgccagaatggtaacagtggttaccctgggttgaaagatccaaagaga

SEQ ID NO: 66735 - DNA, 201 bp, Homo sapiens
gcccctcagccccccatatccttacccggagggtgtaagcccagtttattagtgtgtgtgtgtatgtgtgtgtgtttcctcttagaaacccatattgaggttttttttttttttttttcctttctgagagctgcatagaaaatacagcatctcacagttgatgacaccttagagtcaatgaaatatagtagctggattttg

SEQ ID NO: 66736 - DNA, 201 bp, Homo sapiens
cccctcagccccccatatccttacccggagggtgtaagcccagtttattagtgtgtgtgtgtatgtgtgtgtgtttcctcttagaaacccatattgaggttttttttttttttttttcctttctgagagctgcatagaaaatacagcatctcacagttgatgacaccttagagtcaatgaaatatagtagctggattttga

SEQ ID NO: 66737 - DNA, 201 bp, Homo sapiens
tatttaactattatgagcctcagttccctcctctttaaaatgaggataatcatggcacctacctcataaggttgtcatggggattccagaagtttttgtaygtaaagtagaacagtggctggccacaaacaggtgtttgcattattattaaagtgttgattttgcggacccaaggagctacgatgctgtatctgtgaatga

SEQ ID NO: 66738 - DNA, 201 bp, Homo sapiens
atttttaatcatgtgaaaggggaaaactcatagtaagtatagggagaaggcaatttagctgagaaaagaggcaggagctagcttatagtttagaggagagraaaaagcatagctattggactaatccagaactaggttcaaatcctggctagagcatctataacctggacaatatgtgtttaatagagggttaagaaccca

SEQ ID NO: 66739 - DNA, 201 bp, Homo sapiens
tccctaagtactcttcctcagaaagaatctgtgtcttgcagttctttcagctgttagtatccgtggttagtatacagggtccttgttggtgtgacattaargtgtggggaagaaggctctgtcaatcttttaaattttctttttgacttaaaaaatgatgttctttctttcactttctatatttcttaagtaatttttgct

SEQ ID NO: 66740 - DNA, 201 bp, Homo sapiens
atcactcaataagagaacataatgaccatggtgaaaacaggaccttgaaagcaggcaaagtgtgatgatgtctgtaatgatgtttgggtgtttatctacayaaaatcataagttatgcttagagaaaagggtaaatctcattccctagttaggtaagattttacctcaaatactttttaatttttttttctttaactcctg

SEQ ID NO: 66741 - DNA, 201 bp, Homo sapiens
cttgataaagattgctaaattttttacttcgctaatatgtccctccctcagcataggccattatatatctatatattcatatagatatatgtgtgtaattycttttaggtaaaaaatgcaagcaacttgcagcctcccaccatttcacagggttacacagcacgagacggggaaaggcataaccaccatggttggtcactg

SEQ ID NO: 66742 - DNA, 201 bp, Homo sapiens
ttttttgcacgccttcatattcacaaaaaagaggcttgccccttagtttgaatccaccctttaggggcagaaagaagaaggaaagaaatcaaatcccaggsaacaatatcactcaataagagaacataatgaccatggtgaaaacaggaccttgaaagcaggcaaagtgtgatgatgtctgtaatgatgtttgggtgttta

SEQ ID NO: 66743 - DNA, 201 bp, Homo sapiens
aataagcatcttgataggattgcctttcttaagctgaatgataaaagtaagatgagtttgaatttaaaaaatgcatttttttgcacgccttcatattcacraaaaagaggcttgccccttagtttgaatccaccctttaggggcagaaagaagaaggaaagaaatcaaatcccagggaacaatatcactcaataagagaac

SEQ ID NO: 66744 - DNA, 201 bp, Homo sapiens
gataaatgcatggctgaatgaatgaatgaacaaataagcatcttgataggattgcctttcttaagctgaatgataaaagtaagatgagtttgaatttaaaraatgcatttttttgcacgccttcatattcacaaaaaagaggcttgccccttagtttgaatccaccctttaggggcagaaagaagaaggaaagaaatcaaa

SEQ ID NO: 66745 - DNA, 201 bp, Homo sapiens
atgtgtgtaatttcttttaggtaaaaaatgcaagcaacttgcagcctcccaccatttcacagggttacacagcacgagacggggaaaggcataaccaccayggttggtcactggatatggatacatggatgcagaaactgcattggcttacgaagacacaccaggtttggcaaggagacctttcctcctggtgattcagta

SEQ ID NO: 66746 - DNA, 201 bp, Homo sapiens
agtccctggaattaaatgctattagtgcagcatcccagagagcaaaggaagctgaactgtcagccacttggtggatttctcattggttttttggtcagaartttttttcatatggcatggaaagtgataaaactccattttccgtcttggagaagagatggaaatgacagtccagctgtcctcgtctgaccatacattctg

SEQ ID NO: 66747 - DNA, 201 bp, Homo sapiens
aaaggaagctgaactgtcagccacttggtggatttctcattggttttttggtcagaagtttttttcatatggcatggaaagtgataaaactccattttccrtcttggagaagagatggaaatgacagtccagctgtcctcgtctgaccatacattctgaccttgggatgccagggtgccctcgtaagtgcttggagctggg

SEQ ID NO: 66748 - DNA, 201 bp, Homo sapiens
atgaggtttttcttgatcttggtgaagttcctggtttctgggtcattgtttttactttaactcccaagttaaaaagcatatggtactttatatctactgayaatgaaaactgtaggagccatttaaaaaaaattgacaaggcaagagaagaaatggaatccagcctttgagaggagcacatcagtttctgaggcacttttc

SEQ ID NO: 66749 - DNA, 201 bp, Homo sapiens
gaatttcttgttagggcagccagagtctagggggaaagcacatgcaaacacaataaacctgctagtcccctttagataaaacagaaatgcaatgtttttaratcatgttgcattgcaaacagtaatagcattccatgcagttgtattcagtgaaacctacagaagttgatctgatagcatttggtgcagagaaatacaacc

SEQ ID NO: 66750 - DNA, 201 bp, Homo sapiens
agttaaatgtgcaatgagatagtatgtaaatactaaaattactgtgtaagtgaatatttaataatgaggaaaaaagctcaagcaaagaatgtttaacactrtgttacgaagccctgtgcatacaatggtctatttttataaaaatttttgatatggtttggctctctgtccccacccaaatctcatcttgtagctcccata

SEQ ID NO: 66751 - DNA, 201 bp, Homo sapiens
aagtccccaaaaatgatcatctccaactgagtagattccacattttcgtgtgacctttcatttaatggtggtggagagacttggggtcttatggcttgcattttttttttttagcattactcatagaaagacagccaaatatgccaggatctgctccttaaacttgataaagattgctaaattttttacttcgctaatatg

SEQ ID NO: 66752 - DNA, 201 bp, Homo sapiens
taatagtgaaaaactttttttaaaagcctgaaatagttaaatgtgcaatgagatagtatgtaaatactaaaattactgtgtaagtgaatatttaataatgrggaaaaaagctcaagcaaagaatgtttaacactatgttacgaagccctgtgcatacaatggtctatttttataaaaatttttgatatggtttggctctct

SEQ ID NO: 66753 - DNA, 201 bp, Homo sapiens
ctaagacttttggatttcacagaggagagaagtttcaaaaaatagtttggggattgatttctttaaatttcagtagcagcagcagcagtagcaaccacagytctttaatatgaccattatgtaatagaagaaagggcgtttttttttttccttaacaggaatgatgtagtctcagaataaaagacagtcctttacattgaa

SEQ ID NO: 66754 - DNA, 201 bp, Homo sapiens
acactctaaacaattggctaaagaataggaaaaacaaatggacaaaatggaataaaatggaaaatgccataatacttgactataatataatatatatatawtagaatacatatatttgaacgtatgcttcaatgtatgattgaagtatacattgtatttatatataatatatgtatatgtgtatacttagctggtgttttt

SEQ ID NO: 66755 - DNA, 201 bp, Homo sapiens
tgcaataatagcctagacatttctataagcctactgtaggatttcagcacccctctgttgtctggtttcccagttatgagtaaacaatgtcagtctggggmtcaggtcatttgggaaatcgttgcttcccatctttaggcagaattggaagtttccgactattgtctggatgctaactttgatagggatgaagggatctgt

SEQ ID NO: 66756 - DNA, 201 bp, Homo sapiens
ttatgcgtgtgtgtgtttgtgggtgtgcatgtttgtgtgttttggggtgtgcatgtttatgtgtgtgtttgcgggtgtgcatgtttgtgtgtgtggttgtsgttgtgttttcttaatagaaattttgagaaaattgaaatagaattatttaaatgtttagctttgaaggttcagaagtaacttttaatttaggcagatgaa

SEQ ID NO: 66757 - DNA, 201 bp, Homo sapiens
ggttgtgcctgctacttccttttaccctaactttcccaacacacacatttctataagaatggtgtaattggtttagcttttctggttttttattatcccgygtgtttatttccaggcttatcccttatcagtggtcctgtgtttaagttttccccagacatgaagtccagagtgggtgatacttcatacaatgtatccaaa

SEQ ID NO: 66758 - DNA, 201 bp, Homo sapiens
taccctaactttcccaacacacacatttctataagaatggtgtaattggtttagcttttctggttttttattatcccgcgtgtttatttccaggcttatcmcttatcagtggtcctgtgtttaagttttccccagacatgaagtccagagtgggtgatacttcatacaatgtatccaaagtccttactatctcacagtgtg

SEQ ID NO: 66759 - DNA, 201 bp, Homo sapiens
actcccctgcccacaaacctctaaaggctctgccacttatccaatgaagtgaaagtgtttttactattactaagttggtgcaaaagtaattgcggtttttrccattaatacattttgatagtcaccctgactcatctccatatattctaactctgagcttttgcagatgttattgcctaagggagggaggaacactgtgat

SEQ ID NO: 66760 - DNA, 201 bp, Homo sapiens
gaatgagttactttgcagcagagtgcagtgtttgaggttgagggaaacatcaagaagaaacaaggcaattagattttttttaaattaagaataattcataycttaataaaaccttcacagagcattatccccatccctcctgccaactttccagtgagagcccaggagtaaatacaatgggagggatactttgcatgagct

SEQ ID NO: 66761 - DNA, 201 bp, Homo sapiens
aactttcccaacacacacatttctataagaatggtgtaattggtttagcttttctggttttttattatcccgcgtgtttatttccaggcttatcccttatsagtggtcctgtgtttaagttttccccagacatgaagtccagagtgggtgatacttcatacaatgtatccaaagtccttactatctcacagtgtgacatga

SEQ ID NO: 66762 - DNA, 201 bp, Homo sapiens
actgtaattaaaaaaagagagaatgagttactttgcagcagagtgcagtgtttgaggttgagggaaacatcaagaagaaacaaggcaattagatttttttwaaattaagaataattcatatcttaataaaaccttcacagagcattatccccatccctcctgccaactttccagtgagagcccaggagtaaatacaatggg

SEQ ID NO: 66763 - DNA, 201 bp, Homo sapiens
aagcaaactttgtattgccgtgataaatagaagaacgataaatgcacagaccaagtttgacttgaacacttcatccctcatttgagaatactgtaattaaraaaagagagaatgagttactttgcagcagagtgcagtgtttgaggttgagggaaacatcaagaagaaacaaggcaattagattttttttaaattaagaat

SEQ ID NO: 66764 - DNA, 201 bp, Homo sapiens
acacaacacacataaatactcactcaccttctgagactgacagatgacctgaaaacaaggtagaagatgacacccagcatatatcttcaggccacaaagayggaagcagtgtgaactgatggaaagcatggggctttttgagtcagatatatggggctctaattccatctctgttatttaccagctatgtgtccttcaggg

SEQ ID NO: 66765 - DNA, 201 bp, Homo sapiens
ccttgtaattttctgttgaaaactgttcatattgtatcaggtaatagaaaatgaagtaaatagatattttctgtgaggatttatatcactctggctgggarttaagctatggttaaggtttgctatagttgtatgttccagtagcttcaaattcctctagtgtattagtttcccctcttgatatgggcttccctaagtact

SEQ ID NO: 66766 - DNA, 201 bp, Homo sapiens
ctagatctaaccctgaatttctgtacacaggaaacccactgtcacaaaataagccaatgacaaccgttaagcatgaaaagggctttgctttatcttacccrgggattcctccagattcgagtttgtttgcaatatccacatcccaagaccagacatcaaactgccacttccttagtcccaaaacaccgcacagcaccgagc

SEQ ID NO: 66767 - DNA, 201 bp, Homo sapiens
catgaaaagggctttgctttatcttacccagggattcctccagattcgagtttgtttgcaatatccacatcccaagaccagacatcaaactgccacttccktagtcccaaaacaccgcacagcaccgagccggagtggattccaatcctcatgtcaacatcgtgttttgtccttgaccgcacatacctgttgacataggta

SEQ ID NO: 66768 - DNA, 201 bp, Homo sapiens
taccatggccctcttccacgttatagtcaccgttgagacagtccagcgtggctttggaaatgtgaatcctcctgtgtgtagaaggcataggtcattacacrctcctgatgttgcctgcaaaggctatatttttttgacctgtacaaaaccaacaccaggttacacaagggtattattaggacatgtcctcagggacaatac

SEQ ID NO: 66769 - DNA, 201 bp, Homo sapiens
tgttgacataggtaaatggagagacacatgtataagaccagagtgggcatcgttggctctgcactttcttttctttttttttttttttgagacggagtttygctctgtcgcccaggctggagtgcaatggagctgcaacctctgcctcccgggttcacgctattctcctgcctcagccttgatggtctcgatctcctgacc

SEQ ID NO: 66770 - DNA, 201 bp, Homo sapiens
tctgaagtgtatgtggctcaccagtatggccacagtcttggagcctgtgtctgaggtagggaaactgaatagggcaatgtcagagctgaaaggaattgttsgatcatccagtccagttttgctattgttcaaatgaggacaccgagccttggaggggagaagtggttgcccaaggtctcttagtagcaactggacaaatct

SEQ ID NO: 66771 - DNA, 201 bp, Homo sapiens
ttcagtgttccaatatcatcaaacttctccaggtctttcgatcccaccatacattatgcacctgtatctttgtacatgctatgcctgctccctggtatagmtttttcccccttttgctacctgttaaaatctgacttgtccttcagagccccactcaggtgttaaaatcatgttaagagtctatacccctctggagacttc

SEQ ID NO: 66772 - DNA, 201 bp, Homo sapiens
taaacaatgtcagtctggggctcaggtcatttgggaaatcgttgcttcccatctttaggcagaattggaagtttccgactattgtctggatgctaactttgatagggatgaagggatctgtgacatcctttgattgacttttgttccttggtgtcctgaaatttcagtctatgatgaagaaaataaaacaatgacaaggca

SEQ ID NO: 66773 - DNA, 201 bp, Homo sapiens
tttattgactgacattttcctctttcaatatcagttctgctaaagtattagaaatgtaccaatgtatgtaggatctcctaaactatatgttgatcctttgrgtattgatggcaaatttcaggcatcagtagcaattgcacaaatctggagttgggaggtgggctaccatgatgactaagatagacggctttgaagtcagat

SEQ ID NO: 66774 - DNA, 201 bp, Homo sapiens
ataaaaataggggatcaaaatatttagatactactggtctataagatacaatggaaaattcctagtctggcacacaaaattcctcatgatctgtccagtgycttagttattcttctcattcctcatgcacacattagactccagccatccaaacaacaagtcattgtctgaaccttgtgttccttctttcctctctgggac

SEQ ID NO: 66775 - DNA, 201 bp, Homo sapiens
tatctgtcaaatgggaacattaatatagttcataagtttggcgttaatgtagttcataagtttgaagcattctattattttcctgtttgaacttcagtgcytagcataatcacataaaagaagaatcttataattgtgaagttgacatcatcaaatataaaatgctgtgtttcagaatgtggtgcattgttactctggaaa

SEQ ID NO: 66776 - DNA, 201 bp, Homo sapiens
tatatataagatgcttagaacagtgccttccacgataaccctatataaatgttacctactgtcaatcaattaattatacttattttatttctatactttcwtctatgtgaagcttgccttttcaatggtgttgccttgcaggatgctgtcttctattcctctgtacagtattgtaccttgcactcagcggtgaccccaaaa

SEQ ID NO: 66777 - DNA, 201 bp, Homo sapiens
gataatactttgtagtagaattactagaaaaaccttcattgccccccaaatgcaatgattatgtgacttcaaaatgcttaaaagagttgtcagacttaaargtgagctattcatttgtctttgacagaagacaagtgttccaaatttgctgatatttttgtgataataagtcgccattaatattccttctagcatatattt

SEQ ID NO: 66778 - DNA, 201 bp, Homo sapiens
aggcactgtgttttatctataactgagtctccggcacctggtatatctgctaggttcataataagtgtatatgaaaggaaggaatggatgagtggatagaygaaaggtcaagtgcctttataagaagattgtcgaacacatggacacagggtggggaacatcacacaccggggcctgttgtggggtcaggggagtggggag

SEQ ID NO: 66779 - DNA, 201 bp, Homo sapiens
ttctattagttatacatgattattcccaaatattaaaaaatatagtaaagaataaagaagaaaattaaaactactcaatttcatcacagagctttatgtcmtttctttttataaaaatagatgtattaagaagtggaggttcccattccagcaggggtagctaaaaataaataaaaaattaaaaaagctgaagttggttta

SEQ ID NO: 66780 - DNA, 201 bp, Homo sapiens
atcctgggagattgttggaagcacctcttccaatgagctacaaggctgtacttgcttagattaatgacggttggaaccctggtaccctgggatacaagacrcattaagattggcccatatgagatttatcttaaagagggtcttgccttgtgcaggtttgggttagaagaggattaattagaaggacaagggaaaagaaag

SEQ ID NO: 66781 - DNA, 201 bp, Homo sapiens
cccatttgtgaagtaggcacatcacacttaccctgtaaggttggtgtgagaattaggtggaaaaacatgggcacaccactcccgacatgctacctgtcccraagctctctactcctgtcagtgttggtgaccttgtggatgtttatctatattccaggcaatgaagtgtgtttgctctccatttgttacatggagatagaa

SEQ ID NO: 66782 - DNA, 201 bp, Homo sapiens
gtagctgggattacaggcacgcaccaccatgcctggctaattttgtatttttagtagagatggggtttctccatgttggtcagactggtctcgaactcccratctcaggtgatctgcctgccttggcctcccaaagtgctgggattacaggtgtgagccactgcacctggtcgttacccatttttctattttttacatatg

SEQ ID NO: 66783 - DNA, 201 bp, Homo sapiens
ggagttcgtgaccagcctggccaacatggtgaaatcccatctctactaaaaatacaaaaattagccaagggtgctggcacgcgccggtaatctcagctacytaagaggctgagttggaagaatcgctggaacccgggaggcggaggttgcagtgagccgagatcgtgccattgcactccagcctgggcgacagagtgaaat

SEQ ID NO: 66784 - DNA, 201 bp, Homo sapiens
cctggccaacatggtgaaatcccatctctactaaaaatacaaaaattagccaagggtgctggcacgcgccggtaatctcagctacttaagaggctgagttrgaagaatcgctggaacccgggaggcggaggttgcagtgagccgagatcgtgccattgcactccagcctgggcgacagagtgaaattccatctcaataaaa

SEQ ID NO: 66785 - DNA, 201 bp, Homo sapiens
ttaaataacagaatgaacaatagctcaagcccagatatagattttactcagagcatgcagcagaaaaggaaaatataacctttatgataaggatcctgttsttatcttcctttcatttgcaatgttgtctttcaactgagagattcaatgtccatgttgataactcatttaataatctagccttgaacttcctggatattc

SEQ ID NO: 66786 - DNA, 201 bp, Homo sapiens
cagacacttcaagctccacatgtcccaaagagaattcctagtcttcctcacacaatctcctattccagtactgcttattttagttggaagttctatcatcsacgcagttccaagcaaaaaatctagaattcaaacttgactgattcctctccctcactacccatatctatcatttaattcacttattcaacaaactttaat

SEQ ID NO: 66787 - DNA, 201 bp, Homo sapiens
ataatttctatcttcattaagaatataaaccactggctgactttgtctctaaagtgattttttttccccatccctcctcttttttttttttttttttttttactagcagtagttggcttgtaatagatgctcaattaatccttattgaatgaatgaatacatgaggatgtaactatctgaacatctgctatctacatagca

SEQ ID NO: 66788 - DNA, 201 bp, Homo sapiens
atctctagctaataatgacatctcttataataggtatttggtgacatcaggaaatatctttaggaaatcagcaaataaatatttcaagcattcctatacartttaaccacatcaatcaactatagaataaaaccaagaacctccacctccctcttcttggctctcagttattagtagcaagttcatgtacaatacagatta

SEQ ID NO: 66789 - DNA, 201 bp, Homo sapiens
gccattgtcatcatggcccgttctcaatgagctgttgggtacacctcgcagacggggtggtggccgggcagataaattccctttctttaggcatagtctgwttcaaatattctgtcagtaagcaacagaaaacgggctaataaagatgaacatgattcagagcctttgctatgtcacttacaagctgtgtgtcattggtca

SEQ ID NO: 66790 - DNA, 201 bp, Homo sapiens
aggaagtatataacaccattattttataaaacagcaaactgtaccatgcacaccaactcagagatggaaagaacctaggcattgcaatcagttatgacttktgtgggcataataatttttgggggaaattaaacactcacaaaagagctgtcgaagacctaagggtcaactcttgcaaggcatgcagcctaggttcaacct

SEQ ID NO: 66791 - DNA, 201 bp, Homo sapiens
gtatataacaccattattttataaaacagcaaactgtaccatgcacaccaactcagagatggaaagaacctaggcattgcaatcagttatgacttgtgtgkgcataataatttttgggggaaattaaacactcacaaaagagctgtcgaagacctaagggtcaactcttgcaaggcatgcagcctaggttcaacctgcagc

SEQ ID NO: 66792 - DNA, 201 bp, Homo sapiens
atataaaaatagaatcatgtgggtggctttgaaattgcatgctcctcctgaactccctaactctaggcatcacttggtgctcctttcctatttccaaatcwgcagtgcccccctgattttgaatctcagagggtgacacagaactgatgatggccagctaccgaaaaaggggcattcccatgtacttgatcctccccttta

SEQ ID NO: 66793 - DNA, 201 bp, Homo sapiens
tacagattaatctccaaagcctcccttcttatagatctgagtttgctgagggtacttcaggagtcattgtggggtagggactgccattgtggtggccatgragcccaacttttccttcaaccctgatccattctattgcctctgctggactttagtgtcagcctgccgtatgaaacgtagggtccatctgcttcttaaaat

SEQ ID NO: 66794 - DNA, 201 bp, Homo sapiens
ctaccagagccagtttacaagtgagagaactgagtcacgagaggtatattgctttacgtcacacagttattgatggactagttagaatttcaccccgggtrtataagcctgaacccattggtccatttctacttccctgcatggcttctttaaagggaaatacaaaaggaagtatgtggactactggggtctgagctgact

SEQ ID NO: 66795 - DNA, 201 bp, Homo sapiens
tcagagttctagaaagagcatgggttgtttatttatttttttaactctatagagctttctctttggttgctttcatgcagtgtttcaaaacatcatagctmgaattccttcccactttaacctgtatagcccttattgtaagtgattttgatttcactcacacagttcctttcaggcctttatcatgagagggagattaga

SEQ ID NO: 66796 - DNA, 201 bp, Homo sapiens
acccggagggtgtaagcccagtttattagtgtgtgtgtgtatgtgtgtgtgtttcctcttagaaacccatattgaggttttttttttttttttttcctttytgagagctgcatagaaaatacagcatctcacagttgatgacaccttagagtcaatgaaatatagtagctggattttgagatctaagatctccacttaacc

SEQ ID NO: 66797 - DNA, 201 bp, Homo sapiens
agggtctgcctagtgctgggttttactgtggcaggcccagtgttggggtccaagtcaaagtcctatgcccacttccttctcttttccccaaatggatggtatatttttctgcactgtgctgcttgggatgggggaaggatgatatgggtaatataatataaatttgtcctgcctactccatttaatgtgccttttattatt

SEQ ID NO: 66798 - DNA, 201 bp, Homo sapiens
gtgaagagaagccacctggagccacttttcaatctatgtaatagaatctattatataaacctattttaattaatttaattttatgaacagacatgcatgagatgacattaagtgtttcattggaaataaaattacattcaatctcttttttgccattcatctagctaatatcatgtttctaaaattaagtatttttggtgg

SEQ ID NO: 66799 - DNA, 201 bp, Homo sapiens
ctgattttgaatctcagagggtgacacagaactgatgatggccagctaccgaaaaaggggcattcccatgtacttgatcctcccctttagtttaataacaragggtttattttttccaacatgagtggtttttttttttttttggtaaaattacaattcagcttcacataatatttatttttagctaggttacaaaaaaaa

SEQ ID NO: 66800 - DNA, 201 bp, Homo sapiens
tggacctccacatggcatacagggccttgagtgtctgctcttggctctctctcctgccttttttttttcctccctcacccttctgcaccccatggtctggrcaatgctgaactatgtgcagtctgtcgccagtgctatgcactttctgccttatgggcacttaacatggtgtgtcctgttattcctgcaaggctcagcttt

SEQ ID NO: 66801 - DNA, 201 bp, Homo sapiens
gctgctgaaagggaaagacaaaacctcaaacaggggtccatttctgacagcaaataaagagggtcaacacgaaatttggggacaccagtaaacaaatggtwtattaacatataacattatgatatatgcaatataatattatgaacatttccagtctttatggcttctatcaagttttcaaattggaacaagcaactttgc

SEQ ID NO: 66802 - DNA, 201 bp, Homo sapiens
gaactgatgatggccagctaccgaaaaaggggcattcccatgtacttgatcctcccctttagtttaataacagagggtttattttttccaacatgagtggtttttttttttttttggtaaaattacaattcagcttcacataatatttatttttagctaggttacaaaaaaaaaaaaagagagagagagagggtgttagga

SEQ ID NO: 66803 - DNA, 201 bp, Homo sapiens
cagcatcatagtggtaggatctcacaccagagtttaactgtgggatatgagggccagcagagaagagattcaggatggaggccatgtggtctcttgacttragccacattctgtattccagcttttatcacagttttgcataggctaaatgggcaattgtttggaaatttgtaaaattgatgtttttttttttctcattta

SEQ ID NO: 66804 - DNA, 201 bp, Homo sapiens
aactgatgatggccagctaccgaaaaaggggcattcccatgtacttgatcctcccctttagtttaataacagagggtttattttttccaacatgagtggtttttttttttttttggtaaaattacaattcagcttcacataatatttatttttagctaggttacaaaaaaaaaaaaagagagagagagagggtgttaggaa

SEQ ID NO: 66805 - DNA, 201 bp, Homo sapiens
ctattcatcatgaaattcaggaaaccaaaagcactttaaagttctatggcaagggtattaattacaagattagctttttaagcaaaagtactgacactgtrtattacatttctctggaaatctctgcagcagttcctcagcattcatttatttctttacatgtaaacattataacatcagattgtacattttatctaatta

SEQ ID NO: 66806 - DNA, 201 bp, Homo sapiens
cttccttagtctaccccaggaacttcagagaaaggaaggatgatgagtcaaagcaaatggatccaattgcctacttaatccattcaatgttctctggaagscttcaaatccacttgtcttttgaaacagagtgaaaaagcagaccccactaatgattctccctggctgaactcagcagctatcctcagattcagagctcag

SEQ ID NO: 66807 - DNA, 201 bp, Homo sapiens
aataacagagggtttattttttccaacatgagtggtttttttttttttttggtaaaattacaattcagcttcacataatatttatttttagctaggttacaaaaaaaaaaaaagagagagagagagggtgttaggaaccctctggcatttctggcatttcctgaaattgcatacgaggttaattctgtcctgaggagacag

SEQ ID NO: 66808 - DNA, 201 bp, Homo sapiens
tcccgggttcacgctattctcctgcctcagccttgatggtctcgatctcctgacctcgtgatcctcccgcctcggccttgcaaagtgctgggattacaggygtgagccaccacgcccgtccacctcttcactttcaatgtcaccccttccatgaagccttcttaggttctttaataactagaaagagtctctgaacatcct

SEQ ID NO: 66809 - DNA, 201 bp, Homo sapiens
ccttcttaggttctttaataactagaaagagtctctgaacatccttagccttttatctgtacttttaagggctctttgaaaccttcctccaaaacctgctstgtaacctctgtctcagggaatggcaccagcatctttttctacccaacattaacctgagatagattattgatttcatacttcattacacattccatttcc

SEQ ID NO: 66810 - DNA, 201 bp, Homo sapiens
taataactagaaagagtctctgaacatccttagccttttatctgtacttttaagggctctttgaaaccttcctccaaaacctgctgtgtaacctctgtctyagggaatggcaccagcatctttttctacccaacattaacctgagatagattattgatttcatacttcattacacattccatttccaaccaaaatgtcaac

SEQ ID NO: 66811 - DNA, 201 bp, Homo sapiens
gggatacatgtctggtcatcctctgactgtaagtatggaggaggcatcttgagaagacagaagaatttctaccattggatgatttcctgtagtcatgagcrttctttctttcagagtattttgaacaattttagtttatgattaaatgatgtcatttatgcagaaaatcaaatggtagaagataatactttgtagtagaat

SEQ ID NO: 66812 - DNA, 201 bp, Homo sapiens
tgaacaattttagtttatgattaaatgatgtcatttatgcagaaaatcaaatggtagaagataatactttgtagtagaattactagaaaaaccttcattgccccccaaatgcaatgattatgtgacttcaaaatgcttaaaagagttgtcagacttaaaggtgagctattcatttgtctttgacagaagacaagtgttcca

SEQ ID NO: 66813 - DNA, 201 bp, Homo sapiens
gttgacataggtaaatggagagacacatgtataagaccagagtgggcatcgttggctctgcactttcttttctttttttttttttttgagacggagtttcrctctgtcgcccaggctggagtgcaatggagctgcaacctctgcctcccgggttcacgctattctcctgcctcagccttgatggtctcgatctcctgacct

SEQ ID NO: 66814 - DNA, 201 bp, Homo sapiens
gacaagtgttccaaatttgctgatatttttgtgataataagtcgccattaatattccttctagcatatatttgaaaaaaacacacaaacttgcttaatttrtttcttccaactcaagatgatgacttaagaatgagcaagaaagtaactgatttttaaagaaattgatgctctgaagaaagcattttgagaatggaagttt

SEQ ID NO: 66815 - DNA, 201 bp, Homo sapiens
tcatttccaccacaggctacatatacagctcatccatttattctttcaacaagtgtctgttgaagaactctaaagatataagcagtgacccaaacagacaratcaagttctgcattcatggagcttacatcaatgtggtttattcccattttacaaccaaggaagctggagcccagagaggttaagtcacacgggtgttag

SEQ ID NO: 66816 - DNA, 201 bp, Homo sapiens
ttttgaaaatactcagcacagaacttggttcatagtaagcactatttacaatagttatcataatataaaactggcaaaagcttagttgtgtgtagcaaacraagctcattcaacttcagttttgtttaatatgaatttgatctttttttttttgagatggagtcttgctctgtcacccaggctggagtgcagtggtgcgat

SEQ ID NO: 66817 - DNA, 201 bp, Homo sapiens
aagggaaagacaaaacctcaaacaggggtccatttctgacagcaaataaagagggtcaacacgaaatttggggacaccagtaaacaaatggtatattaacmtataacattatgatatatgcaatataatattatgaacatttccagtctttatggcttctatcaagttttcaaattggaacaagcaactttgcagctgaat

SEQ ID NO: 66818 - DNA, 201 bp, Homo sapiens
aatgccagaaatagggacaaggagagctgctgaaagggaaagacaaaacctcaaacaggggtccatttctgacagcaaataaagagggtcaacacgaaatytggggacaccagtaaacaaatggtatattaacatataacattatgatatatgcaatataatattatgaacatttccagtctttatggcttctatcaagtt

SEQ ID NO: 66819 - DNA, 201 bp, Homo sapiens
tctcttttccccaaatggatggtatatttttctgcactgtgctgcttgggatgggggaaggatgatatgggtaatataatataaatttgtcctgcctactycatttaatgtgccttttattattattgtgctacagctgagtattatgacatctcacctgatttccttagctcttttgaagctattttcacatatgaatac

SEQ ID NO: 66820 - DNA, 201 bp, Homo sapiens
ttccagagtcctcaaccccaataattccttcccccttgatccatcatctgtttgtcagatatgctgaataaaaccaaaagcacttgccacacatccatgargccaaccctggtggcagccttctagtaatttcctattggccataggataaagtgcaacctcttaacatgactgagaaggtcatatgggctctggctgctg

SEQ ID NO: 66821 - DNA, 201 bp, Homo sapiens
ctcttggcaaaactgcaggaattatggcaaagtccagaatggtaggtctcctgacaaaagtgtgttttagaaggagattgtgtaaaatagtttattactcrtctgaggcagacattggataatgatgtgatgatgttcacgtccagggtttgttattcttccaacaaaatgtggagctggtagcctccttgaaactctttg

SEQ ID NO: 66822 - DNA, 201 bp, Homo sapiens
ggtatgctcatggatgctgagttggtcattctttctaaatctccccataggtgtttctccagtccaggatatcatcttccatttagttgttatgtctcctyaggtgcctccttgctgtgacattttctcagacttcccttgttttacatgactttgacaggtttgaggaatactggtgaggtgttttgtagactgtccctc

SEQ ID NO: 66823 - DNA, 201 bp, Homo sapiens
aagatatatgtttagctctgatagccactgaagcctggtatagagataaattgaacttaaaacctgacctttacattactatatcacaaactattaaaaattttttttaaaaagaattatgtttaaacccattgctctctaataaatggtgaaagcagaaaagtctaaattaaattgtaattaatttaagatattttaaaa

SEQ ID NO: 66824 - DNA, 201 bp, Homo sapiens
aaggttggtgcatcagtgagttcccagagggctctaggcagatgggaaacttccctccaaacaggctggaaaaacactccctgacaacacaccattatttstgggcaccagggggagataaatgaaagagaatgcaggcggatcgctttgtcaggaagtcccatgagagagggggccaattgcaaggctcatgtggctcat

SEQ ID NO: 66825 - DNA, 201 bp, Homo sapiens
catgggatcccctaaactcctaaataaaatgttttaaagcctgtatatattaaagttcattctctgtgctgtaaagttttataagttttgataaatgcatrgtgtcaggtatataccattacagtatactgaatgcactaccctaaaaaatatgctggacttcatctcttttattctcctttccctcattccccaagctcc

SEQ ID NO: 66826 - DNA, 201 bp, Homo sapiens
actattaaaaattttttttaaaaagaattatgtttaaacccattgctctctaataaatggtgaaagcagaaaagtctaaattaaattgtaattaatttaaratattttaaaattgtaatcaaattaaaatatttaaattaaattggatactgtaaattaaaatactttaaagtatttttattttctcattatcctttaaaa

SEQ ID NO: 66827 - DNA, 201 bp, Homo sapiens
gcccagcaggtttggctgaatcctgccaggccccaccaacactcacagctcgccaccccgaggtgccttcggtcaggaccctagtcctcattgtctcttargtagtcaagaaactcattctttcctggtattctctggtacccttcttctgatttattacttggataacacataactatcgccgtggctggcatattcata

SEQ ID NO: 66828 - DNA, 201 bp, Homo sapiens
tcttcatttatttacatctttgatttatttcatcagtgttttgaagatttcttgtacaaattttgttaaatttatatttaagtatttcatttttggtgctrttgtaaataatattgtttctttaatttcaaatttcaacgttagatggctgatataaaggaaaacaattgacttttgtatattgacattgtattctgtgac

SEQ ID NO: 66829 - DNA, 201 bp, Homo sapiens
attaaaaattttttttaaaaagaattatgtttaaacccattgctctctaataaatggtgaaagcagaaaagtctaaattaaattgtaattaatttaagatwttttaaaattgtaatcaaattaaaatatttaaattaaattggatactgtaaattaaaatactttaaagtatttttattttctcattatcctttaaaatcc

SEQ ID NO: 66830 - DNA, 201 bp, Homo sapiens
ttttttttaaaaagaattatgtttaaacccattgctctctaataaatggtgaaagcagaaaagtctaaattaaattgtaattaatttaagatattttaaawttgtaatcaaattaaaatatttaaattaaattggatactgtaaattaaaatactttaaagtatttttattttctcattatcctttaaaatccctatatta

SEQ ID NO: 66831 - DNA, 201 bp, Homo sapiens
tatggaggtcaactacgttcattgcccagggcgttttgtgcagctatggaatcatcttcataacaaacctgggtatcactaccagagccagtttacaagtragagaactgagtcacgagaggtatattgctttacgtcacacagttattgatggactagttagaatttcaccccgggtgtataagcctgaacccattggtc

SEQ ID NO: 66832 - DNA, 201 bp, Homo sapiens
ggaatgagggcaaggaacacctggcccacccagggcggaaaccgcttaaaggcattcttaagccacaaacaaaagcatgagcgatctgtgccttaagggcrtgttcctgctgcaattaattcggcccatcccttcgtttccctcaagggatacttttagttaatttaatatctatagaaacaatgctaatgattgctgtta

SEQ ID NO: 66833 - DNA, 201 bp, Homo sapiens
aggtccactaatgtcaacctaatagtggtgtgtgcctgagatcagactggccaagcaagcctgtagccttgagctgtgtggtcctatctgccatcggggcrtgtgtagaggcttagtctgtgggtaccagcctggtatatgggatcatgagggtctgcctagtgctgggttttactgtggcaggcccagtgttggggtcca

SEQ ID NO: 66834 - DNA, 201 bp, Homo sapiens
agtttatgattcatttttcttgaagtttttaaagcctccatttaactttgattttctttataaatgacagaaaaaaactgagagacattctggacatagckaagaaccaattgtactgagccaaataattatctaaagattctcttgtgtggcaaatccttggttttatgtggctgctaaccgaaaaaagaaataacatta

SEQ ID NO: 66835 - DNA, 201 bp, Homo sapiens
tccctggttgtagatgataatgatgtctacccatgaagcgttacaattgcttcagtgaccaggtcaatggcctcataattctgtaattctatattacactrttataggtgaaattggcacttctgactctgaaaatgctggctttatgggactggaactggctaattgatctgattaaaaaatacacacgaaatggtactt

SEQ ID NO: 66836 - DNA, 201 bp, Homo sapiens
attgcaactcttgaagaaggtcttgtttataatatcctcactttgtagataaagaaactgagggtttgaataactgagtaactcaaccacaccttcacagrttgcaaatagagaatccagtgagttttgctctagaatgcagggactcactggctactgcttccttgctattttcagagtaaggctatcttgttcataggt

SEQ ID NO: 66837 - DNA, 201 bp, Homo sapiens
gaaaatggatacaataataggaattatctcataagggttactgggagaatgaaatgaggtaatatatataagatgcttagaacagtgccttccacgataaycctatataaatgttacctactgtcaatcaattaattatacttattttatttctatactttcatctatgtgaagcttgccttttcaatggtgttgccttgc

SEQ ID NO: 66838 - DNA, 201 bp, Homo sapiens
gttaaggactccttgtctcatctctgttctgtcctcacctggccccacttatccttttatatctcagttgtgagcatgaactaatcaagagctagattaastggatttgaatcccagctctaacacctatgcaaccttggacaaaatctttaagctttctatgtctcagtttccttatctagaaaatggatacaataatag

SEQ ID NO: 66839 - DNA, 201 bp, Homo sapiens
ccttccatgtttccatgcctgggatagtcctaagaactcttcctaggtgagggggaggaaaaccacagtgctttcctagactctccattttgactgtaagstaaaaggcactgaaagattcttacatttctacaagatgtagaagatgcttataactaaaacaattatctagttaattgcctaaactgtaactgtactctg

SEQ ID NO: 66840 - DNA, 201 bp, Homo sapiens
ttcttcccaagcaaactgacctctgaacaaatgtggatttaatcatgttaagttgactcacaaggaaacatgctaacatgcgtttaagattgatgggcttsagaagtgcaaggctgggaggacacctgcccaggggtgacagaagaccctaggttggtaatacatttcctaatgttatgtccttccttgatagcggggtta

SEQ ID NO: 66841 - DNA, 201 bp, Homo sapiens
gcctctttgaaacctgtccttcacatctgaaggaggaggccaagatattcatactatgttgggacttactagagcagtaaaaactcaagagcagcctgatrctataacagaataaatctttaaaaatcattttaacaataagatcatgaaaatgactaggagatatgtgatttagaaaaatgaaagagaaaagctgagacc

SEQ ID NO: 66842 - DNA, 201 bp, Homo sapiens
aggtaaatggagagacacatgtataagaccagagtgggcatcgttggctctgcactttcttttctttttttttttttttgagacggagtttcgctctgtckcccaggctggagtgcaatggagctgcaacctctgcctcccgggttcacgctattctcctgcctcagccttgatggtctcgatctcctgacctcgtgatcc

SEQ ID NO: 66843 - DNA, 201 bp, Homo sapiens
ggcaaggacagcagactgtcctcaggctgcttaattaagtaagtttcgatattatgcttcctcaggaattcattcctctctttaccatggccctcttccaygttatagtcaccgttgagacagtccagcgtggctttggaaatgtgaatcctcctgtgtgtagaaggcataggtcattacacgctcctgatgttgcctgca

SEQ ID NO: 66844 - DNA, 201 bp, Homo sapiens
ttaatacgaaggcagtgatgctcctggaaggaacaggataagagggaaaggtctatgtcagcagaaggatcagttcttcagaaaggcttgagaaagaggcragcagggttaggtggtctgcaacttggggtaaggagaacctacctttgaaatatacttctacctgtctttctaaaatatttgaggtgtaacctaaatggg

SEQ ID NO: 66845 - DNA, 201 bp, Homo sapiens
agggaaaggtctatgtcagcagaaggatcagttcttcagaaaggcttgagaaagaggcgagcagggttaggtggtctgcaacttggggtaaggagaacctrcctttgaaatatacttctacctgtctttctaaaatatttgaggtgtaacctaaatgggggtttgaaggacccagaggtggaatggaatcataaagaaatt

SEQ ID NO: 66846 - DNA, 201 bp, Homo sapiens
gtgggatggagagcgtgaatgacttccagtaaaaagctggtggccaggtggatcctcaggtgaacctggagaagtctcagaggttgatagctgaagtcaayttgagcgttcaaagagtccagcttttagattgggaaacggaggcccacagggatgaggtgatgcagtcgaagtcttgccaagggtgtggctaccccagcc

SEQ ID NO: 66847 - DNA, 201 bp, Homo sapiens
atattattatttctcaatctttagggtcttagttgattcaaaaaaaggtcaaaatctaggataaggaatttgaataataaggactaatatctagtgcaagrctggtgctgtgatacacgctttacatgaatgttctcatttaactattgcaactcttgaagaaggtcttgtttataatatcctcactttgtagataaagaa

SEQ ID NO: 66848 - DNA, 201 bp, Homo sapiens
aatttaagcctatgtaaatcttggttagaatgaaagtaaagcatatgggcaaacaatggacattagaaacagcctaaaaattagtttaataaaatgccacygctatattttcctgattgatgaatggatcctcatcacaatgcaatgcaaaataatgagcccctttttaggccaggatgggtgaactgataatagggaaga

SEQ ID NO: 66849 - DNA, 201 bp, Homo sapiens
atggccacgccccagccctgctccttccccattcctggactcggggaccttcccaagggcgttccttgccgacgctctccctctaggagcgtttgggtctstgtagacacccctcattccccattcgccattctcccgctcagggtcagtgtagacgctccagggctcggttctgcttctttcctccccgatgtctcttct

SEQ ID NO: 66850 - DNA, 201 bp, Homo sapiens
caggcaatgcacctgccttggctttccaaagtactgggattacaggtgtgagccaccgcgcccagccctctagttgtttttcaagacagtttttggggtgygggaagtatccacattcctacttcagtgtgtattttgttatgactatatattagtgcagtatggcttgtaaatgatggataaataaacagatatgcgctt

SEQ ID NO: 66851 - DNA, 201 bp, Homo sapiens
tgcacgacgttcatagttgactccacagatccggggtgaggagttcgcccctggactgaccccagagggtccgcggcccgctgaccccgcccgcggatggycacgccccagccctgctccttccccattcctggactcggggaccttcccaagggcgttccttgccgacgctctccctctaggagcgtttgggtctgtgta

SEQ ID NO: 66852 - DNA, 201 bp, Homo sapiens
tcagcctccctagtagctgggattacaggtgcctaccaccatgcccagctaattttttgtattttagtagagacgggatttcaccctgttgcccaggttgrtcttgaactcttgatctcaggcaatgcacctgccttggctttccaaagtactgggattacaggtgtgagccaccgcgcccagccctctagttgtttttca

SEQ ID NO: 66853 - DNA, 201 bp, Homo sapiens
ggctaggctggaaagtggaggatccggtttgctctgggcgggtctggaagcagagccggcggagggagcgccggggccctgggctgcaggaggttgcggcrgccgcggcagcatggtggtgccggagaaggagcaggtgagcgccggaccagggtctgcgggagcgcggagctggggacctcgcctccaggctcccagaga

SEQ ID NO: 66854 - DNA, 201 bp, Homo sapiens
agagctggatccccaagatcttcaagaagaagacctgcacgacgttcatagttgactccacagatccggggtgaggagttcgcccctggactgaccccagrgggtccgcggcccgctgaccccgcccgcggatggccacgccccagccctgctccttccccattcctggactcggggaccttcccaagggcgttccttgcc

SEQ ID NO: 66855 - DNA, 201 bp, Homo sapiens
gtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattt

SEQ ID NO: 66856 - DNA, 201 bp, Homo sapiens
atatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctca

SEQ ID NO: 66857 - DNA, 201 bp, Homo sapiens
ctgaaacagctcgctattcactcctattttcttctttagatttcaattaaaaggcagctctgctagttactgtgttttggctggaatggaaagcctttggratagcagtgttccagtgtgtgaacgtaagtaataggagtaacatttcaggccaatctctcctcttcatctgttcagtatttgacccatgacctcccctaa

SEQ ID NO: 66858 - DNA, 201 bp, Homo sapiens
tcagaccagtagtcctcaaagattttttgcctcagggcaccttttacattttaagattaacaaagatcccaaagaggtttcttttatgtgggttatatctrttggtatttatcatattggaattcaaactgagagattttttaaataagtattgattctttttgtttttgtttttgtttttcctaagagagggtaccagta

SEQ ID NO: 66859 - DNA, 201 bp, Homo sapiens
ctgttgaaagcattaagaatgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaa

SEQ ID NO: 66860 - DNA, 201 bp, Homo sapiens
ccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagttttt

SEQ ID NO: 66861 - DNA, 201 bp, Homo sapiens
ttgaaaaaccttatttctgagactgctacaatgtgaagcatctcaagaacaggcactgagcactcggtaatagcctttgttctgcaggacttttaaagtcmtagatattggggatactggacatttaagtgaaatgtgcttttagagagtaaatgtaattttcatagattttctattgctataacacaatacgtgagacta

SEQ ID NO: 66862 - DNA, 201 bp, Homo sapiens
gtgaactaagtgtcctcttggctgaaacagctcgctattcactcctattttcttctttagatttcaattaaaaggcagctctgctagttactgtgttttgkctggaatggaaagcctttggaatagcagtgttccagtgtgtgaacgtaagtaataggagtaacatttcaggccaatctctcctcttcatctgttcagtat

SEQ ID NO: 66863 - DNA, 201 bp, Homo sapiens
gaaaaaccttatttctgagactgctacaatgtgaagcatctcaagaacaggcactgagcactcggtaatagcctttgttctgcaggacttttaaagtcatrgatattggggatactggacatttaagtgaaatgtgcttttagagagtaaatgtaattttcatagattttctattgctataacacaatacgtgagactaga

SEQ ID NO: 66864 - DNA, 201 bp, Homo sapiens
gtgtgccactacacctggctaattttttgtatttttagtagaaatggggtttcaccgtgttagccaggatggtctctatctcctgacctcgtgatccgccsgcctcggcctcccaaactgctgggattacaggcgtgagccactgcacccggcccagtgtagataattcactttactaaaactcacctggaactttgggga

SEQ ID NO: 66865 - DNA, 201 bp, Homo sapiens
gatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacaga

SEQ ID NO: 66866 - DNA, 201 bp, Homo sapiens
tgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttggctggaatggaaagcctttggaatagcagtgttc

SEQ ID NO: 66867 - DNA, 201 bp, Homo sapiens
gtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttga

SEQ ID NO: 66868 - DNA, 201 bp, Homo sapiens
tggcactttgcattaccatataaaatttagaatcagcttgtcaatttccacaaaaagaatcctacttgaatttgtattgagtttctattgacttagtacawcaatttgtagacattaacaaatttagttttgaagtttaaatttatgaacatgatatatcctcccatttttgaagtcttctttaatttcttttaaaaatat

SEQ ID NO: 66869 - DNA, 201 bp, Homo sapiens
tccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaa

SEQ ID NO: 66870 - DNA, 201 bp, Homo sapiens
gtggatgtcattccagggaggttctgttccactggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttact

SEQ ID NO: 66871 - DNA, 201 bp, Homo sapiens
tggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattacta

SEQ ID NO: 66872 - DNA, 201 bp, Homo sapiens
tgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtg

SEQ ID NO: 66873 - DNA, 201 bp, Homo sapiens
ccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctctttttt

SEQ ID NO: 66874 - DNA, 201 bp, Homo sapiens
ttactaactatgaggccttcagcaggcataggatatagcaaaagaaattcccccataactaacaagtactctggaactgtcctttctacaatgtgtcagcygcctccagaaatcctgcatggtgagcataccctaagccatcaggacaactttttacctgggcaggaagtgttctacagctgtgagcccagctatgacctc

SEQ ID NO: 66875 - DNA, 201 bp, Homo sapiens
gaattttcttggaaatattaaaaaaaattagtaaaatagaaaaaacaaacaatataataatacacctatacctatatctatatttttatctctgtttctasttctgtaaactctctatacccaaatcctggtaaatggctgtaagtcttcttggagaagactaggggaagatttacaatacatgcttttgactgcgtagca

SEQ ID NO: 66876 - DNA, 201 bp, Homo sapiens
tagagtaacctaaatattttaaactatggtttggaaataatctactagtaggaaaaagatgtgttcaaatgaccattacaaagaattccctaagaaacatraaatagctatgcagaatgaaaataagtatatccatacactggcatggtattcagccataaaaaatgatagcataaagaagcacttaatgactagaaagag

SEQ ID NO: 66877 - DNA, 201 bp, Homo sapiens
aaaatgttattattaggggaaaattgagtaaagtgtacctgggatctttctgtgctattccctacaactgcatgggaatctgattatctcaaaataaaatwtttttttttttaagttactactaaatttccaaggggatgggcttcctaccaaagaattgtatattgtgaaattaaatcattcgaacttaaaacaattcaa

SEQ ID NO: 66878 - DNA, 201 bp, Homo sapiens
ttatttatattagttaaaatgttagagtaacctaaatattttaaactatggtttggaaataatctactagtaggaaaaagatgtgttcaaatgaccattayaaagaattccctaagaaacatgaaatagctatgcagaatgaaaataagtatatccatacactggcatggtattcagccataaaaaatgatagcataaaga

SEQ ID NO: 66879 - DNA, 201 bp, Homo sapiens
caaaatgttattattaggggaaaattgagtaaagtgtacctgggatctttctgtgctattccctacaactgcatgggaatctgattatctcaaaataaaawttttttttttttaagttactactaaatttccaaggggatgggcttcctaccaaagaattgtatattgtgaaattaaatcattcgaacttaaaacaattca

SEQ ID NO: 66880 - DNA, 201 bp, Homo sapiens
atcacttgaacctgggacgcggaggttgcagtgagctaagatcacacgactgtgctccagcctggatgacagagtgagatatcacctcaaaaaaaaaaaaacacaaaaaacaagaaacaaaaataatttacatgtaattgaagcgggcttacaggagtataaatacagttgcctgccaggagctcatatgttgctgactct

SEQ ID NO: 66881 - DNA, 201 bp, Homo sapiens
tcttgaaaggccccatgcactataaacctcagaagtgggcatgtattttaacctacttcttagaatttatacttaggaaataatcacacactttttaaagyagtttggtataaacttttcattgcagcattatttatattagttaaaatgttagagtaacctaaatattttaaactatggtttggaaataatctactagta

SEQ ID NO: 66882 - DNA, 201 bp, Homo sapiens
aatcacttgaacctgggacgcggaggttgcagtgagctaagatcacacgactgtgctccagcctggatgacagagtgagatatcacctcaaaaaaaaaaamacacaaaaaacaagaaacaaaaataatttacatgtaattgaagcgggcttacaggagtataaatacagttgcctgccaggagctcatatgttgctgactc

SEQ ID NO: 66883 - DNA, 201 bp, Homo sapiens
ggactctcatgtaccacgagatcaacacatcctcttgaaaggccccatgcactataaacctcagaagtgggcatgtattttaacctacttcttagaatttrtacttaggaaataatcacacactttttaaagcagtttggtataaacttttcattgcagcattatttatattagttaaaatgttagagtaacctaaatatt

SEQ ID NO: 66884 - DNA, 201 bp, Homo sapiens
aatctcatgaggctgaggcaggagaatcacttgaacctgggacgcggaggttgcagtgagctaagatcacacgactgtgctccagcctggatgacagagtragatatcacctcaaaaaaaaaaaaacacaaaaaacaagaaacaaaaataatttacatgtaattgaagcgggcttacaggagtataaatacagttgcctgc

SEQ ID NO: 66885 - DNA, 201 bp, Homo sapiens
gaacctggactctcatgtaccacgagatcaacacatcctcttgaaaggccccatgcactataaacctcagaagtgggcatgtattttaacctacttcttaraatttatacttaggaaataatcacacactttttaaagcagtttggtataaacttttcattgcagcattatttatattagttaaaatgttagagtaaccta

SEQ ID NO: 66886 - DNA, 201 bp, Homo sapiens
aagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctga

SEQ ID NO: 66887 - DNA, 201 bp, Homo sapiens
atgagtatttgtttagggggagggatgtatgttgaggagggtgggaaagtaagttttgggggaagaagcatgaaattaagaatctggggtgtgcatgcacycatgcatatgtgtcttcattttgaaaagcaagaccttaattagccaagaaaactggtattttggactcacctattaatcaattgtcagggcaaagtacca

SEQ ID NO: 66888 - DNA, 201 bp, Homo sapiens
aggagatgagtatttgtttagggggagggatgtatgttgaggagggtgggaaagtaagttttgggggaagaagcatgaaattaagaatctggggtgtgcawgcacccatgcatatgtgtcttcattttgaaaagcaagaccttaattagccaagaaaactggtattttggactcacctattaatcaattgtcagggcaaag

SEQ ID NO: 66889 - DNA, 201 bp, Homo sapiens
cttctccgagaagccgggagcctgttgggcagccggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctg

SEQ ID NO: 66890 - DNA, 201 bp, Homo sapiens
gtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggaga

SEQ ID NO: 66891 - DNA, 201 bp, Homo sapiens
ttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataatta

SEQ ID NO: 66892 - DNA, 201 bp, Homo sapiens
tgggattacaggtgcgacaccatgccaggctaatttttgtatttttaatagagatggggtttcaccatgttggccaggctggtctcgaactcctgacctcrtgatccacctgcctcagcctccaaaaatgctgggattacaggcgtgagccaccatgcctggcaaagaatgacactgggtgtattaaaaagtatgataagt

SEQ ID NO: 66893 - DNA, 201 bp, Homo sapiens
tgttctgtagaatgattattttcaatatgaaattgattacaatatattcttcacattgttttgtgtttgacagcagtggactttgagtaccaaatttttttcgaatagctactatgagggacatattgtgctgggtgttgtggccacatggatgaatggagtcggccttgttaactattaaactcaaaaacacgtgataat

SEQ ID NO: 66894 - DNA, 201 bp, Homo sapiens
agctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggaga

SEQ ID NO: 66895 - DNA, 201 bp, Homo sapiens
tctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgccta

SEQ ID NO: 66896 - DNA, 201 bp, Homo sapiens
cggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctaga

SEQ ID NO: 66897 - DNA, 201 bp, Homo sapiens
ttttccttaaatgaagttgtggagtttaggtgtcagcctggctttgtcatgaaaggaccccccgcaccgtgtgcaatgccaggccctgaacaaatgggagmcagagctaccaagctgctccaggggtgtgtttgcctgaggcctagaagggccctgcaagtgacatgcattgctgttggatcaggagatgagtatttgttt

SEQ ID NO: 66898 - DNA, 201 bp, Homo sapiens
aagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtg

SEQ ID NO: 66899 - DNA, 201 bp, Homo sapiens
ttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggc

SEQ ID NO: 66900 - DNA, 201 bp, Homo sapiens
cctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgg

SEQ ID NO: 66901 - DNA, 201 bp, Homo sapiens
cgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgt

SEQ ID NO: 66902 - DNA, 201 bp, Homo sapiens
aaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttc

SEQ ID NO: 66903 - DNA, 201 bp, Homo sapiens
atgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctc

SEQ ID NO: 66904 - DNA, 201 bp, Homo sapiens
tgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaaggg

SEQ ID NO: 66905 - DNA, 201 bp, Homo sapiens
aatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtg

SEQ ID NO: 66906 - DNA, 201 bp, Homo sapiens
tcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccgactcattggttcctcgtctgccacatgcatcatctc

SEQ ID NO: 66907 - DNA, 201 bp, Homo sapiens
tgtggaagaacctggactctcatgtaccacgagatcaacacatcctcttgaaaggccccatgcactataaacctcagaagtgggcatgtattttaacctayttcttagaatttatacttaggaaataatcacacactttttaaagcagtttggtataaacttttcattgcagcattatttatattagttaaaatgttagag

SEQ ID NO: 66908 - DNA, 201 bp, Homo sapiens
tgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgt

SEQ ID NO: 66909 - DNA, 201 bp, Homo sapiens
cactgtgaatggcctactttgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactc

SEQ ID NO: 66910 - DNA, 201 bp, Homo sapiens
ggagtcttgccatattgcccaggctggtctcaaactcctgggctcaagctatcctcccaccttggcctccaaaagtgttaggattacaagtgtgagccacygtacccagccaaatttttatgttcttttatcccctcacttatcataaacaatttagtcagcttgttttttagcctgcagtattgaatgacatagggcttc

SEQ ID NO: 66911 - DNA, 201 bp, Homo sapiens
taatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgca

SEQ ID NO: 66912 - DNA, 201 bp, Homo sapiens
tgcagcctcaatctcccaggctcaagcgatcttcctgcctcagccttctgagtagctaggactacaggaatgtgccaccatgcgtggctttttaataaaawttttgttgagacagggtctcactatgttgcccaggcttctctcgaactcctgagctcaagcagtcctcctacctcagcctccaaacgtgctgggattaca

SEQ ID NO: 66913 - DNA, 201 bp, Homo sapiens
aatgagcaattgcaagctaataaggaatataaaatgtgtataatcctgggtttagtgatggtgtgaggaaatcagcaatttcaaacccatctggtgggagrataagtgggaacaaactttgtagaagggcaatatactggctgggcactgccctacagtagagtaggacacagtattcagttcttccaagatcagatgaaa

SEQ ID NO: 66914 - DNA, 201 bp, Homo sapiens
ggtcagcttggattgcctttggttctagttataaatcattttctttctttctttctttctttctttctttttttctttctttttctttctttctttctttytctttctttccttccttccttccttccctccttccttccttctttctttctttctctttctttctttctctctttctctttctctctctctctccctctg

SEQ ID NO: 66915 - DNA, 201 bp, Homo sapiens
ataaaataagtgttcagttctttttggtcagcttggattgcctttggttctagttataaatcattttctttctttctttctttctttctttctttttttctttctttttctttctttctttctttttctttctttccttccttccttccttccctccttccttccttctttctttctttctctttctttctttctctcttt

SEQ ID NO: 66916 - DNA, 201 bp, Homo sapiens
acaataggtaaagtttaggctaggccttagacttctcctatattgtaatccctctggtttgccacatatgcatgctgtcaggaagttgatgaggtatgtamagcacaattattttccattttttgcctttaggcaccgactcattggtcactcatctgctgaatgtatcctctcgggcaatactgcccattggagcatgaa

SEQ ID NO: 66917 - DNA, 201 bp, Homo sapiens
taacattttaagtataaaataagtgttcagttctttttggtcagcttggattgcctttggttctagttataaatcattttctttctttctttctttctttytttctttttttctttctttttctttctttctttctttttctttctttccttccttccttccttccctccttccttccttctttctttctttctctttctt

SEQ ID NO: 66918 - DNA, 201 bp, Homo sapiens
agcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattacttaattggtaaagaaattctatattgtgaacttaaaggatcagtag

SEQ ID NO: 66919 - DNA, 201 bp, Homo sapiens
gaaatctccaagaaatctttttcttggcaatagattgcctgggtgaacatgaaactgaaatttgcccttataataggtaaagaaagaaaataatatgcccwtgcattcaaaaccgcaatgcagaattttgaccttgattccaatctgtttagaaactggattgaaaaaatctcaaaattattttcttttaggaaaaacatg

SEQ ID NO: 66920 - DNA, 201 bp, Homo sapiens
gaacaataggtaaagtttaggctaggccttagacttctcctatattgtaatccctctggtttgccacatatgcatgctgtcaggaagttgatgaggtatgkacagcacaattattttccattttttgcctttaggcaccgactcattggtcactcatctgctgaatgtatcctctcgggcaatactgcccattggagcatg

SEQ ID NO: 66921 - DNA, 201 bp, Homo sapiens
ccagctacttgagaggctgaggcaggagaatcacttgaatctgggaggtggaggttgcagtgacattgcactccagcctgggcgacaagagtgaaactctmtctcaaaaataataataataataaataaccaaaatgatatcgaagtcactaataattacaacataatagctactataatgtaacaatgtgtcaagtgtct

SEQ ID NO: 66922 - DNA, 201 bp, Homo sapiens
gtgagagcagaaaaagaagtagaaaagctgggaacaataggtaaagtttaggctaggccttagacttctcctatattgtaatccctctggtttgccacatrtgcatgctgtcaggaagttgatgaggtatgtacagcacaattattttccattttttgcctttaggcaccgactcattggtcactcatctgctgaatgtat

SEQ ID NO: 66923 - DNA, 201 bp, Homo sapiens
catagtggcgtgcacctgtaatcccagctacttgagaggctgaggcaggagaatcacttgaatctgggaggtggaggttgcagtgacattgcactccagcytgggcgacaagagtgaaactctatctcaaaaataataataataataaataaccaaaatgatatcgaagtcactaataattacaacataatagctactata

SEQ ID NO: 66924 - DNA, 201 bp, Homo sapiens
ggatcaaaagcaacaaatcttgtatttataaaaaacatgcctcaagttaaatggcatagtattacacacacacacacacacacacacacacacacacacayattaagggaatacgcaaacaaaaaatggcagaaataatatgggaaaagacagaacttaagaaagaaattgtcaagcaggtctacaaaatgattgttttat

SEQ ID NO: 66925 - DNA, 201 bp, Homo sapiens
catcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaatttt

SEQ ID NO: 66926 - DNA, 201 bp, Homo sapiens
caggatcaaaagcaacaaatcttgtatttataaaaaacatgcctcaagttaaatggcatagtattacacacacacacacacacacacacacacacacacayatattaagggaatacgcaaacaaaaaatggcagaaataatatgggaaaagacagaacttaagaaagaaattgtcaagcaggtctacaaaatgattgtttt

SEQ ID NO: 66927 - DNA, 201 bp, Homo sapiens
gcactccagcctgagcgacagagccagactccgtctaaaaaaacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattacacac

SEQ ID NO: 66928 - DNA, 201 bp, Homo sapiens
acatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggat

SEQ ID NO: 66929 - DNA, 201 bp, Homo sapiens
tcttggaaaaaccttgattaccctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacat

SEQ ID NO: 66930 - DNA, 201 bp, Homo sapiens
ttccttaaatgaagttgtggagtttaggtgtcagcctggctttgtcatgaaaggaccccccgcaccgtgtgcaatgccaggccctgaacaaatgggagacrgagctaccaagctgctccaggggtgtgtttgcctgaggcctagaagggccctgcaagtgacatgcattgctgttggatcaggagatgagtatttgtttag

SEQ ID NO: 66931 - DNA, 201 bp, Homo sapiens
ggttattccggaagaccgttttctatcatctgcctaaaaaactcagtctggacaagtgctaaggacaagtgcaaacgtaagtaactctggagtgggaaccyctctgttagtcaaacatctgtaagatctgattcaatttgttcaaattttgtaactgagttgcatacaacaattagtttgctaaggtgcaatacatatgag

SEQ ID NO: 66932 - DNA, 201 bp, Homo sapiens
ttcccattgggacatatctgaactatgaatgccgccctggttattccggaagaccgttttctatcatctgcctaaaaaactcagtctggacaagtgctaasgacaagtgcaaacgtaagtaactctggagtgggaacccctctgttagtcaaacatctgtaagatctgattcaatttgttcaaattttgtaactgagttgc

SEQ ID NO: 66933 - DNA, 201 bp, Homo sapiens
gaattctataagagtgtaatctctggaagtagtaatctaattgggtagttgacctgtgtatttagaatgtaacattccttattttttgcctctagataccractcattggttcctcgtctgccacatgcatcatctcaggcaacactgtcatttgggataataaaacacctgtttgtgacagtgagttgaaatatgcattc

SEQ ID NO: 66934 - DNA, 201 bp, Homo sapiens
cgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagt

SEQ ID NO: 66935 - DNA, 201 bp, Homo sapiens
ctgtatgtggtttctggaaacgaaatgatcatggcatttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttc

SEQ ID NO: 66936 - DNA, 201 bp, Homo sapiens
tcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatc

SEQ ID NO: 66937 - DNA, 201 bp, Homo sapiens
gaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcat

SEQ ID NO: 66938 - DNA, 201 bp, Homo sapiens
tcaggagaattgcttgaactcgggaggcagaggttgcagtgagcagatattgcaccattgcactccagcctgagcgacagagccagactccgtctaaaaamacaaacaaacaaacaaagcaaatcaaatatataatttatttcaatccatttggtttaaacttcttgtcaaaaaaccaagtctactagacaggatcaaaag

SEQ ID NO: 66939 - DNA, 201 bp, Homo sapiens
ctgggggtctcccactttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaag

SEQ ID NO: 66940 - DNA, 201 bp, Homo sapiens
tgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataacatgagatatgaag

SEQ ID NO: 66941 - DNA, 201 bp, Homo sapiens
tcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctcca

SEQ ID NO: 66942 - DNA, 201 bp, Homo sapiens
tggcaatgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgc

SEQ ID NO: 66943 - DNA, 201 bp, Homo sapiens
gctttgagttcctggcaccttcattacaagtttatttcatgagaaaccgtcattgcaggacatgattgagggaaaacccccattcactgggggtctcccaytttcatgactaaaattaagtaatgaatgacttgggacaagaaagagaagtggattaaataactaaaagatgcgacaatcttgggctttgagatctttgga

SEQ ID NO: 66944 - DNA, 201 bp, Homo sapiens
aaaaaggagaatgatgaattcctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttacagaaa

SEQ ID NO: 66945 - DNA, 201 bp, Homo sapiens
tcttgtagatcataccttgttactgctttgagttcctggcaccttcattacaagtttatttcatgagaaaccgtcattgcaggacatgattgagggaaaayccccattcactgggggtctcccactttcatgactaaaattaagtaatgaatgacttgggacaagaaagagaagtggattaaataactaaaagatgcgaca

SEQ ID NO: 66946 - DNA, 201 bp, Homo sapiens
atacacattaaagaataagcaaagacacaaaaattgtaccatttaagtatgtttcccaggcaattaataagcaaatttttaaaaaggagaatgatgaattsctaaagaaatctcaatgagatagaaaagtggtaaaaacaaacaacaacaacaaaaaaccataaacacaaaaactggcaatgtaatcataatttagtaata

SEQ ID NO: 66947 - DNA, 201 bp, Homo sapiens
gagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgt

SEQ ID NO: 66948 - DNA, 201 bp, Homo sapiens
cttctgttgagccaagctaatattcacatctagaggctccagatacacattaaagaataagcaaagacacaaaaattgtaccatttaagtatgtttcccargcaattaataagcaaatttttaaaaaggagaatgatgaattcctaaagaaatctcaatgagatagaaaagtggtaaaaacaaacaacaacaacaaaaaac

SEQ ID NO: 66949 - DNA, 201 bp, Homo sapiens
agatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccataga

SEQ ID NO: 66950 - DNA, 201 bp, Homo sapiens
aggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcaccc

SEQ ID NO: 66951 - DNA, 201 bp, Homo sapiens
tagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatag

SEQ ID NO: 66952 - DNA, 201 bp, Homo sapiens
tatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggca

SEQ ID NO: 66953 - DNA, 201 bp, Homo sapiens
atagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccata

SEQ ID NO: 66954 - DNA, 201 bp, Homo sapiens
atatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggc

SEQ ID NO: 66955 - DNA, 201 bp, Homo sapiens
tgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtg

SEQ ID NO: 66956 - DNA, 201 bp, Homo sapiens
aatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagatagg

SEQ ID NO: 66957 - DNA, 201 bp, Homo sapiens
gaaatctttttcttggcaatagattgcctgggtgaacatgaaactgaaatttgcccttataataggtaaagaaagaaaataatatgcccatgcattcaaarccgcaatgcagaattttgaccttgattccaatctgtttagaaactggattgaaaaaatctcaaaattattttcttttaggaaaaacatgtccatgtatag

SEQ ID NO: 66958 - DNA, 201 bp, Homo sapiens
aaatctttttcttggcaatagattgcctgggtgaacatgaaactgaaatttgcccttataataggtaaagaaagaaaataatatgcccatgcattcaaaaycgcaatgcagaattttgaccttgattccaatctgtttagaaactggattgaaaaaatctcaaaattattttcttttaggaaaaacatgtccatgtatagg

SEQ ID NO: 66959 - DNA, 201 bp, Homo sapiens
gatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttggttatgtcgtggtaatccaga

SEQ ID NO: 66960 - DNA, 201 bp, Homo sapiens
tgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacatt

SEQ ID NO: 66961 - DNA, 201 bp, Homo sapiens
ggtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcg

SEQ ID NO: 66962 - DNA, 201 bp, Homo sapiens
tctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccggtggcctggggtgaaacgctggggggcgtgggg

SEQ ID NO: 66963 - DNA, 201 bp, Homo sapiens
aatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatc

SEQ ID NO: 66964 - DNA, 201 bp, Homo sapiens
acacatatcaaaattgtatttcatcccacatatcaactagaggaaaggtgaatgcataacactgaaagtcacggaactgttttattcgtttttttttttttatacagtggttctcaaagtgctgttatctatccaaatcagctgtgaaacttttaaaaaatatagactcctgggctctaacccagacccactaaatcagag

SEQ ID NO: 66965 - DNA, 201 bp, Homo sapiens
caatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagaccca

SEQ ID NO: 66966 - DNA, 201 bp, Homo sapiens
cgaatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagata

SEQ ID NO: 66967 - DNA, 201 bp, Homo sapiens
aacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacata

SEQ ID NO: 66968 - DNA, 201 bp, Homo sapiens
cacgaatgaatatatgtagtcagtgtgtttatatatttcatttcatatatgtgtcatatatatgtgtgtgtgtatgtatatatatatatatatatatatayatatataaaacactgaatattgcagaaaattaaagcaaagagtaagaagagttaaccaaattttccctcaatgcagtgggaaaagatgaaaaggagaaga

SEQ ID NO: 66969 - DNA, 201 bp, Homo sapiens
aagagggaaaggaaactacatcaagcattctttgttgaaggctcatatgttccttttttgggctactatgcaaatttatattattacctatactatgcatwtactactataaaggtaagaatattaggtaattaaggggaaggaacttctttctttccaagaatggttcattatatttgctttgttgctttgatctagttc

SEQ ID NO: 66970 - DNA, 201 bp, Homo sapiens
tgcacacgaatgaatatatgtagtcagtgtgtttatatatttcatttcatatatgtgtcatatatatgtgtgtgtgtatgtatatatatatatatatatayatatatatataaaacactgaatattgcagaaaattaaagcaaagagtaagaagagttaaccaaattttccctcaatgcagtgggaaaagatgaaaaggag

SEQ ID NO: 66971 - DNA, 201 bp, Homo sapiens
agaaccagccacaaattgagggattggtaataaagagggaaaggaaactacatcaagcattctttgttgaaggctcatatgttccttttttgggctactaygcaaatttatattattacctatactatgcatatactactataaaggtaagaatattaggtaattaaggggaaggaacttctttctttccaagaatggttc

SEQ ID NO: 66972 - DNA, 201 bp, Homo sapiens
tttgcacacgaatgaatatatgtagtcagtgtgtttatatatttcatttcatatatgtgtcatatatatgtgtgtgtgtatgtatatatatatatatatayatatatatatataaaacactgaatattgcagaaaattaaagcaaagagtaagaagagttaaccaaattttccctcaatgcagtgggaaaagatgaaaagg

SEQ ID NO: 66973 - DNA, 201 bp, Homo sapiens
caattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacagg

SEQ ID NO: 66974 - DNA, 201 bp, Homo sapiens
agtttgcacacgaatgaatatatgtagtcagtgtgtttatatatttcatttcatatatgtgtcatatatatgtgtgtgtgtatgtatatatatatatatayatatatatatatataaaacactgaatattgcagaaaattaaagcaaagagtaagaagagttaaccaaattttccctcaatgcagtgggaaaagatgaaaa

SEQ ID NO: 66975 - DNA, 201 bp, Homo sapiens
agttcaaccgtttcttaaaaccttacacacacacctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaatt

SEQ ID NO: 66976 - DNA, 201 bp, Homo sapiens
aacgctgcaacaagcatgtcagttggcatcatttatccaacagtgtgtgttgacttcgtgtctctgtgtagcattttggttattctcacaatatcccagakgttttcattattatcatgtctgtgatagtgatctgtcttcagtgatctttgatgttactattttcattgtttggagtccctacgaactgcacccatataa

SEQ ID NO: 66977 - DNA, 201 bp, Homo sapiens
tgaaactagccatgaagtttgcacacgaatgaatatatgtagtcagtgtgtttatatatttcatttcatatatgtgtcatatatatgtgtgtgtgtatgtrtatatatatatatatatatatatatatataaaacactgaatattgcagaaaattaaagcaaagagtaagaagagttaaccaaattttccctcaatgcagt

SEQ ID NO: 66978 - DNA, 201 bp, Homo sapiens
gtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacaaaaagacttgtacatgaattttcataacagtttt

SEQ ID NO: 66979 - DNA, 201 bp, Homo sapiens
attgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaa

SEQ ID NO: 66980 - DNA, 201 bp, Homo sapiens
acagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggct

SEQ ID NO: 66981 - DNA, 201 bp, Homo sapiens
aaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattccgaccct

SEQ ID NO: 66982 - DNA, 201 bp, Homo sapiens
agctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagc

SEQ ID NO: 66983 - DNA, 201 bp, Homo sapiens
ggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatcactatacacttataaggatgagagtgaaaaaagacaa

SEQ ID NO: 66984 - DNA, 201 bp, Homo sapiens
ttcactgtccctcttcgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagatagggtaggatgtaaaggcttcaatctgtttaaat

SEQ ID NO: 66985 - DNA, 201 bp, Homo sapiens
ttattctcattttttcctaacccaaccacctggttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcatttcctgaaccatg

SEQ ID NO: 66986 - DNA, 201 bp, Homo sapiens
agcctgggcgacagagcgagattccgtctcaaaatcaatcaatcaatcaatcaatcaatcactatacacttataaggatgagagtgaaaaaagacaatatkttggtggtattgtgaatcaccaatttagaaaatggatatatttaaaaattgcaaaggatttctcagctagcgctcagttaagcatattttctcattaaat

SEQ ID NO: 66987 - DNA, 201 bp, Homo sapiens
atattttctgaatctcattatttaaggttaacaatgtgctaacctaaacaattcacaggatttgttttttattctcattttttcctaacccaaccacctgkttcaaggcacatagattaagaaggaaaatggaaatgggactaatatcccaggcttcactgtccctcttcgggccctggggaggagactcccaaaagtcta

SEQ ID NO: 66988 - DNA, 201 bp, Homo sapiens
gaacacaggtattaactcctgattgaaatgaacaaagataggagaagattaggggaaaaatctgtgtccttgctggaaaccagggcagtgcacacataaakagtatgccgttcactggatgggaaggaaaaaaaattaggagtatagtagtcaaagcacacaaacaaccctaacccagagtagacattgctggaagaaagg

SEQ ID NO: 66989 - DNA, 201 bp, Homo sapiens
cccattcatttggagttggtgtcttccaggtggctacccttaagctgtgtgctcaaataaactctatccttaaatatattttctgaatctcattatttaargttaacaatgtgctaacctaaacaattcacaggatttgttttttattctcattttttcctaacccaaccacctggttcaaggcacatagattaagaagga

SEQ ID NO: 66990 - DNA, 201 bp, Homo sapiens
ggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccg

SEQ ID NO: 66991 - DNA, 201 bp, Homo sapiens
ccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagac

SEQ ID NO: 66992 - DNA, 201 bp, Homo sapiens
tatgcatgctgtcaggaagttgatgaggtatgtacagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagt

SEQ ID NO: 66993 - DNA, 201 bp, Homo sapiens
atgcaggttgagaccttacgtactgaagagagttcagattactctacctggctccaaaacattttctttcccacaggtaaatcatgtgaaactcctccagwtccagtgaatggcatggtgcatgtgatcacagacatccatgttggatccagaatcaactattcttgtactacagggtgagttggcagcaacatctcttgg

SEQ ID NO: 66994 - DNA, 201 bp, Homo sapiens
cctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaa

SEQ ID NO: 66995 - DNA, 201 bp, Homo sapiens
taattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagag

SEQ ID NO: 66996 - DNA, 201 bp, Homo sapiens
tagctgaccttcccacacacattcttgcaaagaggaaaagtcaagcagggtgtttggaggtgagttgccatcatccaccgcctttgtctggaaggaagcgyagggcctcacacgcgggatccatcggaagcccaagcattgtcaagctctgctgctgcacctgggtcagcaaggtgggctctgccagcgaaactcgttaga

SEQ ID NO: 66997 - DNA, 201 bp, Homo sapiens
ctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaatta

SEQ ID NO: 66998 - DNA, 201 bp, Homo sapiens
ggcatttcattagctgaccttcccacacacattcttgcaaagaggaaaagtcaagcagggtgtttggaggtgagttgccatcatccaccgcctttgtctgkaaggaagcgcagggcctcacacgcgggatccatcggaagcccaagcattgtcaagctctgctgctgcacctgggtcagcaaggtgggctctgccagcgaa

SEQ ID NO: 66999 - DNA, 201 bp, Homo sapiens
aggcctcatgtgccaaacagctagcgagttgcaaaggcaaagcaaaagtacttgaaggaaacttaaagtgctattccagtgaacacatgaatgataagaargtgaaacagccttattgctgatatggaagaagttttagtggtctagatacaagatcaaactagacatatttccttaagctaaagcctaatcctgagcaag

SEQ ID NO: 67000 - DNA, 201 bp, Homo sapiens
taactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaat

SEQ ID NO: 67001 - DNA, 201 bp, Homo sapiens
aaatgaacaaagataggagaagattaggggaaaaatctgtgtccttgctggaaaccagggcagtgcacacataaagagtatgccgttcactggatgggaargaaaaaaaattaggagtatagtagtcaaagcacacaaacaaccctaacccagagtagacattgctggaagaaagggaagggcatgtagcagctgtgtgag

SEQ ID NO: 67002 - DNA, 201 bp, Homo sapiens
aaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaataatggaatctgtaa

SEQ ID NO: 67003 - DNA, 201 bp, Homo sapiens
agaatactggttaccagaggttggggtagggagagacaatgggagatggagagagattggttaaagggcacagggtcacagatacataagaataaattcayccttgaatacttaaccctctgccctacatctgtcactcctacatccatattcattgctaatcctggggctaactcttgattgctttcttctcactactaa

SEQ ID NO: 67004 - DNA, 201 bp, Homo sapiens
catgtgatcacagacatccatgttggatccagaatcaactattcttgtactacagggtgagttggcagcaacatctcttggttccagagttccagcacagyaatactaccttctagccacatctcaggaaggaaactaggctgttgccacctgctcttgagaggtttgaacacaggtattaactcctgattgaaatgaaca

SEQ ID NO: 67005 - DNA, 201 bp, Homo sapiens
tctaaaaaagctcatctcatagaagtagagagtagaatactggttaccagaggttggggtagggagagacaatgggagatggagagagattggttaaaggrcacagggtcacagatacataagaataaattcatccttgaatacttaaccctctgccctacatctgtcactcctacatccatattcattgctaatcctggg

SEQ ID NO: 67006 - DNA, 201 bp, Homo sapiens
ctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggc

SEQ ID NO: 67007 - DNA, 201 bp, Homo sapiens
aatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggtt

SEQ ID NO: 67008 - DNA, 201 bp, Homo sapiens
aatgctcacttcatgagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattt

SEQ ID NO: 67009 - DNA, 201 bp, Homo sapiens
agtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaataga

SEQ ID NO: 67010 - DNA, 201 bp, Homo sapiens
gtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaagattgtgtaggaag

SEQ ID NO: 67011 - DNA, 201 bp, Homo sapiens
gctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggttt

SEQ ID NO: 67012 - DNA, 201 bp, Homo sapiens
atttgagaaatatttcccaagaacgtaggccccttcctcagcactgtgtccccaggatcctgatgagtggctgacacaggataagtgctaaattaagaaakattgactaaatgaatgagtaacccttcaaaacggttatttttcttcttcaaatgttttgctacttcattaaagttgtaaagtaagtaaacttgcattgga

SEQ ID NO: 67013 - DNA, 201 bp, Homo sapiens
atacatttgagaaatatttcccaagaacgtaggccccttcctcagcactgtgtccccaggatcctgatgagtggctgacacaggataagtgctaaattaakaaagattgactaaatgaatgagtaacccttcaaaacggttatttttcttcttcaaatgttttgctacttcattaaagttgtaaagtaagtaaacttgcat

SEQ ID NO: 67014 - DNA, 201 bp, Homo sapiens
tgatgatcaatatcagtaagtaatcagtgaaagttttcacctatttaagatgattagcacacatatatacatttgagaaatatttcccaagaacgtaggcyccttcctcagcactgtgtccccaggatcctgatgagtggctgacacaggataagtgctaaattaagaaagattgactaaatgaatgagtaacccttcaaa

SEQ ID NO: 67015 - DNA, 201 bp, Homo sapiens
ttacatcagaggcctgattcatttcaaaaccttcctcagagcaaggggtaattgccaggtaccctttaaagccagaattaatacatataacccatatttaygctgtctcaagactaattagcatggtgttgcatgctagacaaataagttcaactccagaaaacatgtaaaaactaacagaagtttcaacttgaatatctt

SEQ ID NO: 67016 - DNA, 201 bp, Homo sapiens
atgccaccacacctggctaattttttatattttgtagagatggagtcttgccatattgcccaggctggtctcaaactcctgggctcaagctatcctcccaycttggcctccaaaagtgttaggattacaagtgtgagccaccgtacccagccaaatttttatgttcttttatcccctcacttatcataaacaatttagtca

SEQ ID NO: 67017 - DNA, 201 bp, Homo sapiens
cttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagaatgtagtaatcatgagaatt

SEQ ID NO: 67018 - DNA, 201 bp, Homo sapiens
ggtgcgacaccatgccaggctaatttttgtatttttaatagagatggggtttcaccatgttggccaggctggtctcgaactcctgacctcatgatccaccygcctcagcctccaaaaatgctgggattacaggcgtgagccaccatgcctggcaaagaatgacactgggtgtattaaaaagtatgataagtgacatgatca

SEQ ID NO: 67019 - DNA, 201 bp, Homo sapiens
cacacacacatattaagggaatacgcaaacaaaaaatggcagaaataatatgggaaaagacagaacttaagaaagaaattgtcaagcaggtctacaaaatrattgttttattttggtgccaggtacagtccacaatgaagtcaagatattaagaagtaaagtggaccaggagaagttagagcagaaatatctcttttcaat

SEQ ID NO: 67020 - DNA, 201 bp, Homo sapiens
gatttccattataaaatatgaaacgtagtgagcatttttttggtttttttttgagacggagtctcgctctgttgcccaggctggagtgcagtggcatgatytcggctcactgcaagctctgcctcccgggttcccgccattctcctgcctcagcctcccgagtagctggggctacaggcacccgccaccatgccaggctaa

SEQ ID NO: 67021 - DNA, 201 bp, Homo sapiens
accccaagcacattacttttatgatttattactggttatcttctaggatttccattataaaatatgaaacgtagtgagcatttttttggtttttttttgaracggagtctcgctctgttgcccaggctggagtgcagtggcatgatctcggctcactgcaagctctgcctcccgggttcccgccattctcctgcctcagcc

SEQ ID NO: 67022 - DNA, 201 bp, Homo sapiens
aaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgagacggagtctcgctctgttgcccaggctggagtg

SEQ ID NO: 67023 - DNA, 201 bp, Homo sapiens
gcagggctattgttatcactgagactgatgatcaatatcagtaagtaatcagtgaaagttttcacctatttaagatgattagcacacatatatacatttgwgaaatatttcccaagaacgtaggccccttcctcagcactgtgtccccaggatcctgatgagtggctgacacaggataagtgctaaattaagaaagattga

SEQ ID NO: 67024 - DNA, 201 bp, Homo sapiens
cggaagggattattgtcctgatttcagcactgctatctctggtttcactttccttgcagcagaagcaagagactaattgtaggaagagcattagcctgcgyagactatgcttaattaacatcatttctgtggtcttcagtttccatttagtttaatgagattgttgaactcaaatctcaatcactggattctaatttgttt

SEQ ID NO: 67025 - DNA, 201 bp, Homo sapiens
cactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaagaa

SEQ ID NO: 67026 - DNA, 201 bp, Homo sapiens
tgtgctagggagaattgtgttctatttctctaccttttactaactatgaggccttcagcaggcataggatatagcaaaagaaattcccccataactaacargtactctggaactgtcctttctacaatgtgtcagccgcctccagaaatcctgcatggtgagcataccctaagccatcaggacaactttttacctgggcag

SEQ ID NO: 67027 - DNA, 201 bp, Homo sapiens
atcagcagctgtgcttatgactggagagattattttgatatgacggaagggattattgtcctgatttcagcactgctatctctggtttcactttccttgcrgcagaagcaagagactaattgtaggaagagcattagcctgcgcagactatgcttaattaacatcatttctgtggtcttcagtttccatttagtttaatga

SEQ ID NO: 67028 - DNA, 201 bp, Homo sapiens
tcactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaaga

SEQ ID NO: 67029 - DNA, 201 bp, Homo sapiens
gcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcagcagaagcaagagactaattgtaggaagagcattagcctgcgc

SEQ ID NO: 67030 - DNA, 201 bp, Homo sapiens
aggaagagactattataaacaaatcagtagatgctagaaaggagtaacaacttgaaacctgacccagaaagtaaaaaaagaaaataaatcatcaacagacsttgacattttcaaaagcaaagcaatctgaatccatttggagttttttataatggcctgaatatgtttcaattcactgtggcagggctattgttatcactg

SEQ ID NO: 67031 - DNA, 201 bp, Homo sapiens
atctgttgacacctttactgagtttgttcctattgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactggg

SEQ ID NO: 67032 - DNA, 201 bp, Homo sapiens
attgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacaggg

SEQ ID NO: 67033 - DNA, 201 bp, Homo sapiens
tttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagct

SEQ ID NO: 67034 - DNA, 201 bp, Homo sapiens
aaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaaaacaaacaaacaaacaaagcaaatcaaatatataatttatttca

SEQ ID NO: 67035 - DNA, 201 bp, Homo sapiens
ctgtagactggagctgttcctatttggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctata

SEQ ID NO: 67036 - DNA, 201 bp, Homo sapiens
gagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgattttt

SEQ ID NO: 67037 - DNA, 201 bp, Homo sapiens
caaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattg

SEQ ID NO: 67038 - DNA, 201 bp, Homo sapiens
tccccagtgagatgaacccggtacctcagttggaaatgcagaaatcacccgtcttctgtgtcgctcacactgggagctgtagactggagctgttcctattyggccatcttggctcctccctcctattttattcttttcagagtgatctgttgacacctttactgagtttgttcctattgcaggactctttgattttctgga

SEQ ID NO: 67039 - DNA, 201 bp, Homo sapiens
ccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatct

SEQ ID NO: 67040 - DNA, 201 bp, Homo sapiens
tccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatc

SEQ ID NO: 67041 - DNA, 201 bp, Homo sapiens
ctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaat

SEQ ID NO: 67042 - DNA, 201 bp, Homo sapiens
aaaattaaacccagtattttttccctaagacttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaa

SEQ ID NO: 67043 - DNA, 201 bp, Homo sapiens
gacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggcggtggtccaggcttggagtgacatgccata

SEQ ID NO: 67044 - DNA, 201 bp, Homo sapiens
ttactctacctggctccaaaacattttctttcccacaggtaaatcatgtgaaactcctccagttccagtgaatggcatggtgcatgtgatcacagacatcyatgttggatccagaatcaactattcttgtactacagggtgagttggcagcaacatctcttggttccagagttccagcacagcaatactaccttctagcca

SEQ ID NO: 67045 - DNA, 201 bp, Homo sapiens
tagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaagg

SEQ ID NO: 67046 - DNA, 201 bp, Homo sapiens
gaaagcctttggaatagcagtgttccagtgtgtgaacgtaagtaataggagtaacatttcaggccaatctctcctcttcatctgttcagtatttgacccaygacctcccctaatgtggttcttcaattttctaatctgaattattgatttgaaaatttcttattttagtaatgtttggttgtgaatcaatgtgtacatcac

SEQ ID NO: 67047 - DNA, 201 bp, Homo sapiens
tgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaa

SEQ ID NO: 67048 - DNA, 201 bp, Homo sapiens
cttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccatcttgaattgatttttg

SEQ ID NO: 67049 - DNA, 201 bp, Homo sapiens
tttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtc

SEQ ID NO: 67050 - DNA, 201 bp, Homo sapiens
ttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaag

SEQ ID NO: 67051 - DNA, 201 bp, Homo sapiens
gtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgc

SEQ ID NO: 67052 - DNA, 201 bp, Homo sapiens
ataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctgg

SEQ ID NO: 67053 - DNA, 201 bp, Homo sapiens
tgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttg

SEQ ID NO: 67054 - DNA, 201 bp, Homo sapiens
gaaagattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaaga

SEQ ID NO: 67055 - DNA, 201 bp, Homo sapiens
ctgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactcttt

SEQ ID NO: 67056 - DNA, 201 bp, Homo sapiens
ggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcac

SEQ ID NO: 67057 - DNA, 201 bp, Homo sapiens
ttggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagtt

SEQ ID NO: 67058 - DNA, 201 bp, Homo sapiens
gaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctaga

SEQ ID NO: 67059 - DNA, 201 bp, Homo sapiens
ccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcgagactccgtgggcgtaggaccc

SEQ ID NO: 67060 - DNA, 201 bp, Homo sapiens
atactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctc

SEQ ID NO: 67061 - DNA, 201 bp, Homo sapiens
gtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgt

SEQ ID NO: 67062 - DNA, 201 bp, Homo sapiens
ctagttactgtgttttggctggaatggaaagcctttggaatagcagtgttccagtgtgtgaacgtaagtaataggagtaacatttcaggccaatctctccycttcatctgttcagtatttgacccatgacctcccctaatgtggttcttcaattttctaatctgaattattgatttgaaaatttcttattttagtaatgtt

SEQ ID NO: 67063 - DNA, 201 bp, Homo sapiens
aaaatctctcagcatttgcttgtctgtaaagtattttatttctccttcacttatgaagcttagtttggctggatatgaaattctgggttgaaaattctttyctttaagaatgttgaatattggccctcactctcttctggcttgtagagtttctgctgagagatccgctgttagtctgatgggcgtccctttgtgggtaac

SEQ ID NO: 67064 - DNA, 201 bp, Homo sapiens
gtgacaaaatctctcagcatttgcttgtctgtaaagtattttatttctccttcacttatgaagcttagtttggctggatatgaaattctgggttgaaaatyctttcctttaagaatgttgaatattggccctcactctcttctggcttgtagagtttctgctgagagatccgctgttagtctgatgggcgtccctttgtgg

SEQ ID NO: 67065 - DNA, 201 bp, Homo sapiens
gtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttc

SEQ ID NO: 67066 - DNA, 201 bp, Homo sapiens
tgcactgtggtctgagagacagtttgttataatttctgttcttttacatttgctgtggagcgctttacttccaactatgtggtcaattttggaataagtgyggtgtggtgctgaaaagaatgtatattctgttgatttggggtggagagttctgtagatgtctattaggtctgcttggtgcagagctgggttcaattcctg

SEQ ID NO: 67067 - DNA, 201 bp, Homo sapiens
cttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctag

SEQ ID NO: 67068 - DNA, 201 bp, Homo sapiens
gctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaa

SEQ ID NO: 67069 - DNA, 201 bp, Homo sapiens
aggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggac

SEQ ID NO: 67070 - DNA, 201 bp, Homo sapiens
agacagacagacagacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaa

SEQ ID NO: 67071 - DNA, 201 bp, Homo sapiens
tgtcaactcaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttaca

SEQ ID NO: 67072 - DNA, 201 bp, Homo sapiens
atgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatg

SEQ ID NO: 67073 - DNA, 201 bp, Homo sapiens
atctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcc

SEQ ID NO: 67074 - DNA, 201 bp, Homo sapiens
gggctcaagctatcctcccaccttggcctccaaaagtgttaggattacaagtgtgagccaccgtacccagccaaatttttatgttcttttatcccctcacktatcataaacaatttagtcagcttgttttttagcctgcagtattgaatgacatagggcttcccatgtgctaggactttccatgtgtagaaaatgcaatga

SEQ ID NO: 67075 - DNA, 201 bp, Homo sapiens
aggtgagatcatggcttactgcaaccgccacctccctggctcaagcaattctcctgcctgagcctcccaagcagctgggactacaggtgcatgctaccacrcctggttaaattttttatattttttttatagagatcgaatctcaccatgtttcccaggcttgtctcgaacacctgagctgaagcaatccacccacctggg

SEQ ID NO: 67076 - DNA, 201 bp, Homo sapiens
agggtcttgatctgtcactcaagttggactgcagaggtgagatcatggcttactgcaaccgccacctccctggctcaagcaattctcctgcctgagcctcycaagcagctgggactacaggtgcatgctaccacacctggttaaattttttatattttttttatagagatcgaatctcaccatgtttcccaggcttgtctc

SEQ ID NO: 67077 - DNA, 201 bp, Homo sapiens
gcccaggctggtctcaaactcctgggctcaagctatcctcccaccttggcctccaaaagtgttaggattacaagtgtgagccaccgtacccagccaaattyttatgttcttttatcccctcacttatcataaacaatttagtcagcttgttttttagcctgcagtattgaatgacatagggcttcccatgtgctaggactt

SEQ ID NO: 67078 - DNA, 201 bp, Homo sapiens
ttatggagacagcaaagacgtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctgacagaaatgagaaataga

SEQ ID NO: 67079 - DNA, 201 bp, Homo sapiens
ttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttc

SEQ ID NO: 67080 - DNA, 201 bp, Homo sapiens
ctgattaaaaggcaggtctgctagtcattgtgtcttggctggaatgaaagccctttggaatagcagtgttccagtgtgtgaacgtgagtagaaagaactaygtagtttggatagctctccttatttttgttttccagtgttttactgcacggaatcacttgtctggatctttacttaactaaattactgattaaaatactt

SEQ ID NO: 67081 - DNA, 201 bp, Homo sapiens
tggatccccttctctctctctctctacgttcctcgcactgaccaacctctttgtgatcttcaggcgtgccatacccccagcccgtaataaaatctttactkccatcttgtgtttcttgtaatgactgaagaggttttctctatcataaagatcctaaatgaaaacatacccgcatatgagctctttctggtgtgtttcctt

SEQ ID NO: 67082 - DNA, 201 bp, Homo sapiens
agggagagatgggaattgctcacacatttgctaccacttttttttttctttaggttctgattaaaaggcaggtctgctagtcattgtgtcttggctggaaygaaagccctttggaatagcagtgttccagtgtgtgaacgtgagtagaaagaactatgtagtttggatagctctccttatttttgttttccagtgttttac

SEQ ID NO: 67083 - DNA, 201 bp, Homo sapiens
gtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaag

SEQ ID NO: 67084 - DNA, 201 bp, Homo sapiens
tagaagggtgaggagggtggagaagagttttattgagtgacaaaacagcttctcagcagagaagagacacaagggtggaccccagatgaagtcagggggtyattctctcagtgtggctggttctggagcctttatggactcagaattggaagtgtgtgttaattggttggtgagtatgcaaaaaaggctaaaacaaagcca

SEQ ID NO: 67085 - DNA, 201 bp, Homo sapiens
taatctaattgggtagttgacctgtgtatttagaatgtaacattccttattttttgcctctagataccgactcattggttcctcgtctgccacatgcatcrtctcaggcaacactgtcatttgggataataaaacacctgtttgtgacagtgagttgaaatatgcattcctatttcttttaccgatacattctaatttttc

SEQ ID NO: 67086 - DNA, 201 bp, Homo sapiens
tttataaaatgtatgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctc

SEQ ID NO: 67087 - DNA, 201 bp, Homo sapiens
cagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataatttta

SEQ ID NO: 67088 - DNA, 201 bp, Homo sapiens
acctgggatctttctgtgctattccctacaactgcatgggaatctgattatctcaaaataaaatttttttttttttaagttactactaaatttccaagggsatgggcttcctaccaaagaattgtatattgtgaaattaaatcattcgaacttaaaacaattcaaacttatagctgggagaactttaaattattctgagcc

SEQ ID NO: 67089 - DNA, 201 bp, Homo sapiens
aaatgttattattaggggaaaattgagtaaagtgtacctgggatctttctgtgctattccctacaactgcatgggaatctgattatctcaaaataaaattwttttttttttaagttactactaaatttccaaggggatgggcttcctaccaaagaattgtatattgtgaaattaaatcattcgaacttaaaacaattcaaa

SEQ ID NO: 67090 - DNA, 201 bp, Homo sapiens
gttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctgttcttttacatttgctgtggagcgcttt

SEQ ID NO: 67091 - DNA, 201 bp, Homo sapiens
tgctcgctgctagtgcagcagtgtgagatccacctgggatgctggaacttggctgggggaggagcatccgacattgctaaggcttgactgggcggttctakgctcacagtgtaaacaaagcgccagggaagcctgaactgggtggagcccactgcagctcagcaaggcctactgcctctctagattccacctctgggtgca

SEQ ID NO: 67092 - DNA, 201 bp, Homo sapiens
tgcctggctggggaggtcccacgcccacggagccttgctcgctgctagtgcagcagtgtgagatccacctgggatgctggaacttggctgggggaggagcrtccgacattgctaaggcttgactgggcggttctaggctcacagtgtaaacaaagcgccagggaagcctgaactgggtggagcccactgcagctcagcaag

SEQ ID NO: 67093 - DNA, 201 bp, Homo sapiens
gtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactg

SEQ ID NO: 67094 - DNA, 201 bp, Homo sapiens
actctacctggctccaaaacattttctttcccacaggtaaatcatgtgaaactcctccagttccagtgaatggcatggtgcatgtgatcacagacatccakgttggatccagaatcaactattcttgtactacagggtgagttggcagcaacatctcttggttccagagttccagcacagcaatactaccttctagccaca

SEQ ID NO: 67095 - DNA, 201 bp, Homo sapiens
acctaactgatgactttgagtttcccattgggacatatctgaactatgaatgccgccctggttattccggaagaccgttttctatcatctgcctaaaaaaytcagtctggacaagtgctaaggacaagtgcaaacgtaagtaactctggagtgggaacccctctgttagtcaaacatctgtaagatctgattcaatttgtt

SEQ ID NO: 67096 - DNA, 201 bp, Homo sapiens
gcggagcttgcagcgagccgagatcgcgccactgcactccagcctgggcgacagagcgagattccgtctcaaaatcaatcaatcaatcaatcaatcaatchctatacacttataaggatgagagtgaaaaaagacaatatgttggtggtattgtgaatcaccaatttagaaaatggatatatttaaaaattgcaaaggatt

SEQ ID NO: 67097 - DNA, 201 bp, Homo sapiens
tgattatcatcaccggcaactacaacttcttcaacctgatgacgctggtgcttaccactgcgctgctggacgaccagcacctggctgctgagcctggccayggcagccgcaagaagacggccacctgtgcgtgtcacttgtccagccccctgccctcccaggggttctcccctccaacacccccacaggactcccactcta

SEQ ID NO: 67098 - DNA, 201 bp, Homo sapiens
cactgtgcactactttggcctggaggttgactggcagcagcgcaccatccactccagaaccagtgagtgccgacctgggggggccagagggcaggggcggrccagtcctcacacccccctcctccaccagctttcaccttccaccagttttctcagtggctgaagacactgacgctgcccactgtgtggctgggtgtggcc

SEQ ID NO: 67099 - DNA, 201 bp, Homo sapiens
tgggcactgcgaccgtggccttgttcctgattagcctggtgggtagcgctgcagggctgggggatgggctgggggcagggcagccctgagaacctcccacytgtctccaggtgccgtactcctacgtggagcccgggacccacgggcgcctctggaccggggcccaccgcctgtttggtgccgtggagcacctacagctgg

SEQ ID NO: 67100 - DNA, 201 bp, Homo sapiens
cggttgtggtgccccaccagccacgcctggactggcagatgtggtttgcagccctgggcccacacacgcacagcccgtggttcacaagcctggtcttgcgyctgctgcagggcaaggagccaggtgcggagcgggcttggggggtgtggagtgggctggggtggagcggggtggggaggggaggggcagggcgggtactgt

SEQ ID NO: 67101 - DNA, 201 bp, Homo sapiens
ggaggttgactggcagcagcgcaccatccactccagaaccagtgagtgccgacctgggggggccagagggcaggggcggaccagtcctcacacccccctcstccaccagctttcaccttccaccagttttctcagtggctgaagacactgacgctgcccactgtgtggctgggtgtggcctccctggtctgggagctgctg

SEQ ID NO: 67102 - DNA, 201 bp, Homo sapiens
cagggctcggccttcagcgctgctcagcgtgccctgttggggacagcgtggctcccggggacagctggcaaccgctgttgggaaggccttgtagcagaggratgcaccctgcagggtggaggtgggtgcctgccacggggccaggcgtcagtctccgggagcactgagagcgggccgcccccaggtgctgctgcaggtcct

SEQ ID NO: 67103 - DNA, 201 bp, Homo sapiens
gctgctttctactcgcaggtgggtgagggccgcagctgtcagagagaggcagacagggctcggccttcagcgctgctcagcgtgccctgttggggacagcrtggctcccggggacagctggcaaccgctgttgggaaggccttgtagcagagggatgcaccctgcagggtggaggtgggtgcctgccacggggccaggcgt

SEQ ID NO: 67104 - DNA, 201 bp, Homo sapiens
cgagactggggctggacacggcccagggcctggagctgctgagcctgctgggtgcactagtggccctgggagccctgctgctgagcccactgcgccacccygtcatctacttgctgctttgggccgcctacctgtcagcctgccaggcaagtgggacctgtgaccagctcactctatctccaacccccaccacccacccct

SEQ ID NO: 67105 - DNA, 201 bp, Homo sapiens
gagagcgggccgcccccaggtgctgctgcaggtcctgattatcatcaccggcaactacaacttcttcaacctgatgacgctggtgcttaccactgcgctgytggacgaccagcacctggctgctgagcctggccacggcagccgcaagaagacggccacctgtgcgtgtcacttgtccagccccctgccctcccaggggtt

SEQ ID NO: 67106 - DNA, 201 bp, Homo sapiens
ctacagctggccaactcctacggcctcttccgccgcatgactgggcttggtggacggcctgaggtggtgctggagggcagttacgacggccaccactggayggtgagccctcccagggcgggcagggtggtggggcccaggtcagcgggcccagctgacctcggcctgcctggcaggagatcgagttcatgtacaagcctg

SEQ ID NO: 67107 - DNA, 201 bp, Homo sapiens
ccaggctgggggaggtggcaggggtgaccccagcctcccggggtaaacccagtaagcacttccccaacctccctccctccctccctcccacaggagaaaarcccacctcgcacccgcagcgccaacagcaccctggcccaggccctccactggactcgctctcagctgtctcccctggaggcccccgccctgctctggggg

SEQ ID NO: 67108 - DNA, 201 bp, Homo sapiens
aggggtaaggccgggcaccggggtggggtgtggagcctggggtgcaggggtaaggccgggcactggggggggtgtggagcccggggtgcaggggtaaggcygggcaccgggtggggtgtggagcccggggtgcaggggtaaggccgggcaccagggggggatgtggagcgtgaggagctgaggagcaggggtaaggctggg

SEQ ID NO: 67109 - DNA, 201 bp, Homo sapiens
gctcaagacccttcccctgccctgggctgtgggggtctgagtctagagcccccaaccctaggccccgtgccagaggggaagaggctgactcccaggggaaraggggaagcactgtcatcttccacgtcatcttcacaccagcccatcctgccctttagatctgggcaccaataaaggcgtcttttgtgcttggctgtgtgc

SEQ ID NO: 67110 - DNA, 201 bp, Homo sapiens
cctccccaggactcccactattgcctctgtgattggcccaggaggaaaacacgaccaagctcaagacccttcccctgccctgggctgtgggggtctgagtytagagcccccaaccctaggccccgtgccagaggggaagaggctgactcccaggggaagaggggaagcactgtcatcttccacgtcatcttcacaccagcc

SEQ ID NO: 67111 - DNA, 201 bp, Homo sapiens
gctgctgagcctggccacggcagccgcaagaagacggccacctgtgcgtgtcacttgtccagccccctgccctcccaggggttctcccctccaacaccccyacaggactcccactctagctgcaccccagccccctggctggggaccctctgctgacccatgactgtcctgccccacagcctggcccaaggccctgctggc

SEQ ID NO: 67112 - DNA, 201 bp, Homo sapiens
catgcccctccccaggactcccactattgcctctgtgattggcccaggaggaaaacacgaccaagctcaagacccttcccctgccctgggctgtgggggtytgagtctagagcccccaaccctaggccccgtgccagaggggaagaggctgactcccaggggaagaggggaagcactgtcatcttccacgtcatcttcaca

SEQ ID NO: 67113 - DNA, 201 bp, Homo sapiens
gggggtctgagtctagagcccccaaccctaggccccgtgccagaggggaagaggctgactcccaggggaagaggggaagcactgtcatcttccacgtcatyttcacaccagcccatcctgccctttagatctgggcaccaataaaggcgtcttttgtgcttggctgtgtgcctggtgctgctttcccaggaggcatgagga

SEQ ID NO: 67114 - DNA, 201 bp, Homo sapiens
gtgcctgccacggggccaggcgtcagtctccgggagcactgagagcgggccgcccccaggtgctgctgcaggtcctgattatcatcaccggcaactacaayttcttcaacctgatgacgctggtgcttaccactgcgctgctggacgaccagcacctggctgctgagcctggccacggcagccgcaagaagacggccacct

SEQ ID NO: 67115 - DNA, 201 bp, Homo sapiens
cctgccacggggccaggcgtcagtctccgggagcactgagagcgggccgcccccaggtgctgctgcaggtcctgattatcatcaccggcaactacaacttyttcaacctgatgacgctggtgcttaccactgcgctgctggacgaccagcacctggctgctgagcctggccacggcagccgcaagaagacggccacctgtg

SEQ ID NO: 67116 - DNA, 201 bp, Homo sapiens
ctgtcagatttgtgcaggccctgctagcaccctgttctctccggtcctccccgctggcaccagtcagcggggagaagcgcaggccagcctcccagaaagastccggagctgcctccgaacaggccaccgcagcccccaacccctgctccagtagttcgaggaccacccggcgaaagaagtagctgtgttctcccagctgca

SEQ ID NO: 67117 - DNA, 201 bp, Homo sapiens
ccccctgccctcccaggggttctcccctccaacacccccacaggactcccactctagctgcaccccagccccctggctggggaccctctgctgacccatgrctgtcctgccccacagcctggcccaaggccctgctggccaccctgtcgctgctgctggaactagccgtctacgggcttctggcctatggcactgtgcact

SEQ ID NO: 67118 - DNA, 201 bp, Homo sapiens
tggtgccccaccagccacgcctggactggcagatgtggtttgcagccctgggcccacacacgcacagcccgtggttcacaagcctggtcttgcgcctgctkcagggcaaggagccaggtgcggagcgggcttggggggtgtggagtgggctggggtggagcggggtggggaggggaggggcagggcgggtactgtgggggc

SEQ ID NO: 67119 - DNA, 201 bp, Homo sapiens
aggtcagcgggcccagctgacctcggcctgcctggcaggagatcgagttcatgtacaagcctgggaacctgagccggccgcccccggttgtggtgccccaycagccacgcctggactggcagatgtggtttgcagccctgggcccacacacgcacagcccgtggttcacaagcctggtcttgcgcctgctgcagggcaagg

SEQ ID NO: 67120 - DNA, 201 bp, Homo sapiens
acgcacggactgtcctgggcaaaggtgttcacctttccgagcctcggtttccttatctgtaaagcaaagcgacaccagcaagcctgtgagcattgtgtatrtagcagacatggaggtcctgcagcaggaggtgctcaataaacacaaagcgactgaaggatgggatgtgcgagaatcccagtggtgtgcacccaggccgcg

SEQ ID NO: 67121 - DNA, 201 bp, Homo sapiens; identical to SEQ ID NO: 59817

SEQ ID NO: 67122 - DNA, 201 bp, Homo sapiens
ccccacagacctaatatatgtccggacagcttggatgctgccacgtaaggtcactgctgtggcgagtcttgctatgtctgggtgccccatagtcacagaayacctggacaccgccacatgcagtcatcatcatgttactttcaggagcctcaacacgagagctcaacactgcctccgaccagtccctctgaggcccacagg

SEQ ID NO: 67123 - DNA, 201 bp, Homo sapiens
cagatctgagtgccccacagagtcacagtgtgtctggacagcctggacattggacattgctaagttgggtcactgccacatggagtcttgccatgcctgtktgccccacagacctaatatatgtccggacagcttggatgctgccacgtaaggtcactgctgtggcgagtcttgctatgtctgggtgccccatagtcacag

SEQ ID NO: 67124 - DNA, 201 bp, Homo sapiens; identical to SEQ ID NO: 17161

SEQ ID NO: 67125 - DNA, 201 bp, Homo sapiens; identical to SEQ ID NO: 17162

SEQ ID NO: 67126 - DNA, 201 bp, Homo sapiens; identical to SEQ ID NO: 59811

SEQ ID NO: 67127 - DNA, 201 bp, Homo sapiens
tacagagtccctctgcccagtcctggtcactgtcttgtgattctcagtccccaacttgtccccggaaaagagtagatagggtgggggctaaggacaccccygggagggatgagtcataggtggggggctgcctcatgccaggaagcatgtaccagctcccaccccagggggctgagggagataaatgggccctgaagcggg

SEQ ID NO: 67128 - DNA, 201 bp, Homo sapiens
gcctcctcagttgaagaagctggatctggcagctgcggcagcacacaccttctttgtagcaaaccccatgcacctgcagatgcgggaggacatggctaagwacagacgaatgtcgggagttcggccccagagcttccgggacctggagacgcccccacactgggtgagaatcccagcaccacccctgtcttgccaccagcc

SEQ ID NO: 67129 - DNA, 201 bp, Homo sapiens
gaggtttagtttcctagactggggtgataataatagtacgtattttaaagggtcattgtaggaagtaatttaggtaatgtacctaaaagaatgaggcagcrcctggtaatgataagcaattaatgaatgttaggtgggaaatttccggacaccaggggctaggattgggtaggaggagaggggcagtgattgttcatctgg

SEQ ID NO: 67130 - DNA, 201 bp, Homo sapiens
tcattgtaggaagtaatttaggtaatgtacctaaaagaatgaggcagcgcctggtaatgataagcaattaatgaatgttaggtgggaaatttccggacacyaggggctaggattgggtaggaggagaggggcagtgattgttcatctgggtgtggggtgtgaaaatggttccaatatctgtatccccttctgcatagagtc

SEQ ID NO: 67131 - DNA, 201 bp, Homo sapiens
ggtgggtgatgatgcttttctggactgtcgcaggacccctggacccctgcagctctcatccctgaggcacttagagaaaagctcaggtaggatatgccccrtggtgggaggggcttggcccgagctgggaggctgggtctggactgtcctgggcacccactgagcgcatctctcacccctgagagaggatcaagagaagag

SEQ ID NO: 67132 - DNA, 201 bp, Homo sapiens; identical to SEQ ID NO: 47904

SEQ ID NO: 67133 - DNA, 201 bp, Homo sapiens
tttaagtccagatgctctgaagctgctgagggggaacgttgaacagaggaaccggggggcatggtgccaggttcaaggagcatggagcacccaggcagtgycctagagccggcgcttccctgccttcctccagctacccctcactgctcatcatctcaccctcaggacatccagcgcttcatcctccgatccctgggggag

SEQ ID NO: 67134 - DNA, 201 bp, Homo sapiens
ctcgaaaaataaatttttttaaataattaattaattaattaattaattaaaaaagaacatagaatcatcagggtgtatgttaccaagagacagtatagggraagagggagagagcccacacatgaaggccgagggacagtgagtgtcttctgtggcctcccaaggagtttgggctttatctgtgtatggtagacagctgtt

SEQ ID NO: 67135 - DNA, 201 bp, Homo sapiens
aggtggagattgcagtgagctatgatggcgccactgcactccagcctgggcgatagagcaagaccccgtctcaaaaacaaaaaatgaaaaaaaaaaaaaaaccccaggttagacggcttgggtgactaggtgtctctcagaagtgagatttgtatgcaggcgtaactagatagtggtgcttaaacaaattcaaaaagtaga

SEQ ID NO: 67136 - DNA, 201 bp, Homo sapiens
agtgtagacatccagatattaggagacccccaggtagtgagagtggtcgcggaggtggctgggtagttgtgactcagtatcaaggagtgggggagccacgsagtccacagtttctccgagagcatgtcaggtgggaagaggtcagagagggatagcccgctgatgctgtctccctaccgccagtctggcctaactgtggaa

SEQ ID NO: 67137 - DNA, 201 bp, Homo sapiens; identical to SEQ ID NO: 47907

SEQ ID NO: 67138 - DNA, 201 bp, Homo sapiens
agcccttcctgcctagttcccagctctgccccacttttccagctgtccctaccctctcagaggcccccttactgctgtaggaagctctcccgagttctctscacagtccccttagtaagcgggattccagcccgtaccagagagggacaatcggacagccgtggcggtgggcactctctgggaaagagcagcagctcagga

SEQ ID NO: 67139 - DNA, 201 bp, Homo sapiens
ttgttggggcagagggcagggcctgtcctatgccttggagggtgttcagcagcttccctggtctctacccagtagagatcaatagcacattgacagccccygagtcatggcaatcaatgtttccacactttgcctaatgacccctgggggcagaagtgtcctgcttgagaacgactggctaaatgtgtgaactctgaagct

SEQ ID NO: 67140 - DNA, 201 bp, Homo sapiens; identical to SEQ ID NO: 47909

SEQ ID NO: 67141 - DNA, 201 bp, Homo sapiens
cagcaagctctctgtccctgcacccccaccatcttggggacctacaagggcctggactcagaggacagtgcacaggctagcctggagctcaccaggcctgsggagctgggacggggccccgctgccggacctgcagccctggacagatggggaacactgtgcctccctgaacggaaatggcaggggaggaggctgatgctt

SEQ ID NO: 67142 - DNA, 201 bp, Homo sapiens
cagtttgggctgatggacagagctggatgctgacagactccaaacccatgggtggagagcggcagagttgggcaggggctagggccgagaccaccctcccmttgccttcctccttttctgccctgcctttcactgcctgcagctggcccgggctgggacagtgggcagtcagggtgctaagctgcttctggaggtgagcga

SEQ ID NO: 67143 - DNA, 201 bp, Homo sapiens; identical to SEQ ID NO: 47913

SEQ ID NO: 67144 - DNA, 201 bp, Homo sapiens
gaggggcatgaacaagctgaatggcttatgggtttcctctgcaggacactggattcaggtcctgcagtgccggcaacgctgtgtgggggaaacagccacaygccctggtcgcagcttccctgtcccagacttccttcccaaccagctgaggcggctacatgaggcccatgctcagggtcagttggggaagggtggaaacgg

SEQ ID NO: 67145 - DNA, 201 bp, Homo sapiens
taatgaatgttaggtgggaaatttccggacaccaggggctaggattgggtaggaggagaggggcagtgattgttcatctgggtgtggggtgtgaaaatggytccaatatctgtatccccttctgcatagagtctggtactgcatgcacagccccagattgcttcaagccctggattcaaagggctgagtgggaaaaatcag

SEQ ID NO: 67146 - DNA, 201 bp, Homo sapiens
caggctagcctggagctcaccaggcctggggagctgggacggggccccgctgccggacctgcagccctggacagatggggaacactgtgcctccctgaacrgaaatggcaggggaggaggctgatgctttaaatgaagaggatggtggggttgggaggtataaccctgctcctctctcccagtctgtgcaataaaggtcgt

SEQ ID NO: 67147 - DNA, 201 bp, Homo sapiens
ggaggaggctgatgctttaaatgaagaggatggtggggttgggaggtataaccctgctcctctctcccagtctgtgcaataaaggtcgtgaagatctctcmgccaggggccagtcaagtgtatcacagattctgtgatggctggaggtgggggtggctctggctggcctgggaggagacaggtgtctttgggcctcccaga

SEQ ID NO: 67148 - DNA, 201 bp, Homo sapiens
tagttgtacttgttgttacagtttgatccactgcccagggctcctgacattgagtcccgggcttttcctacctccgtcttcctctctggaaacagaagaamcttaatgagatatttcagctctaatgtcagggattccaggggctgaccttggtgggtgatgatgcttttctggactgtcgcaggacccctggacccctgc

SEQ ID NO: 67149 - DNA, 201 bp, Homo sapiens
gcggttctgattggccagtcttccatgaggctctggggcacccagagtgtgtgtctggggtagggtggggaggctggccagggggcagaggtctgcccccygtcccagggctctgatgccctcctcccttcgcctcctcagttgaagaagctggatctggcagctgcggcagcacacaccttctttgtagcaaaccccatg

SEQ ID NO: 67150 - DNA, 201 bp, Homo sapiens
gggaatgggccacactctcctccccaaccccaggagtggatagaagccaaagaactgctgcaggagtcacaggaggaggaggaagaggaagaggaagaaaygcccagcaaagacccttccccagagccccctagccgcaggcaccagagggtccaagacaagactggaagggcacctcgggttcgggaggagctgtgagtg

SEQ ID NO: 67151 - DNA, 201 bp, Homo sapiens
actcagaggacagtgcacaggctagcctggagctcaccaggcctggggagctgggacggggccccgctgccggacctgcagccctggacagatggggaacmctgtgcctccctgaacggaaatggcaggggaggaggctgatgctttaaatgaagaggatggtggggttgggaggtataaccctgctcctctctcccagtc

SEQ ID NO: 67152 - DNA, 201 bp, Homo sapiens
gtcccagggctctgatgccctcctcccttcgcctcctcagttgaagaagctggatctggcagctgcggcagcacacaccttctttgtagcaaaccccatgyacctgcagatgcgggaggacatggctaagtacagacgaatgtcgggagttcggccccagagcttccgggacctggagacgcccccacactgggtgagaat

SEQ ID NO: 67153 - DNA, 201 bp, Homo sapiens
cggggacggcgctgtgccctggcactgtggcacacgtgggcacctgagcacagggagcaggtaaggagcggggtaggaagggatgtggttctcctggtgcrtgaagggtgggcaaggagcccccgagaaggctcacagtcggtgagggtcaggggctgagctgacccagggaaggtgggtgcagggaatgggccacactct

SEQ ID NO: 67154 - DNA, 201 bp, Homo sapiens
gagagctggggccggggttgttgtcatggagagagaaggagcagtttgggctgatggacagagctggatgctgacagactccaaacccatgggtggagagyggcagagttgggcaggggctagggccgagaccaccctccccttgccttcctccttttctgccctgcctttcactgcctgcagctggcccgggctgggaca

SEQ ID NO: 67155 - DNA, 201 bp, Homo sapiens
acctgataggacccagcgtggagaaaagggatgttctgagagctggggccggggttgttgtcatggagagagaaggagcagtttgggctgatggacagagytggatgctgacagactccaaacccatgggtggagagcggcagagttgggcaggggctagggccgagaccaccctccccttgccttcctccttttctgccc

SEQ ID NO: 67156 - DNA, 201 bp, Homo sapiens
ggaggcacccgggcccgtctgatgcccagacctggaggagaggctgtgcaggaagccgggccccagggcctgggcttttgtgaaggagctttcttgggacygagactacctgataggacccagcgtggagaaaagggatgttctgagagctggggccggggttgttgtcatggagagagaaggagcagtttgggctgatgg

SEQ ID NO: 67157 - DNA, 201 bp, Homo sapiens
gacccatgtcccacccaactccgacgtctttagatcccctttccctcggtgccagccttctgagagtcccaacgttctggcctctaggggatctgcagttygggcggtgggcggttctgattggccagtcttccatgaggctctggggcacccagagtgtgtgtctggggtagggtggggaggctggccagggggcagagg

SEQ ID NO: 67158 - DNA, 201 bp, Homo sapiens
gaccatccgtggagacccctttttcctttggttcccaactcctcttgcatttttgctctgcaagttgaagctgatttctcatttgccccaagctagtccckgaattaaggagtaggaagtggtagcgagagagctgatcctctctgtgcccctgtccccatcctgctctagggagtgagggccaagttctctgagagagcc

SEQ ID NO: 67159 - DNA, 201 bp, Homo sapiens
gtgcccagggaggggcatgaacaagctgaatggcttatgggtttcctctgcaggacactggattcaggtcctgcagtgccggcaacgctgtgtgggggaarcagccacacgccctggtcgcagcttccctgtcccagacttccttcccaaccagctgaggcggctacatgaggcccatgctcagggtcagttggggaaggg

SEQ ID NO: 67160 - DNA, 201 bp, Homo sapiens
  misc_feature (1)...(201): n = A,T,C or G, or insertion/deletion polymorphism (see Tables 1-2)
cgagaaggctcacagtcggtgagggtcaggggctgagctgacccagggaaggtgggtgcagggaatgggccacactctcctccccaaccccaggagtgganagaagccaaagaactgctgcaggagtcacaggaggaggaggaagaggaagaggaagaaatgcccagcaaagacccttccccagagccccctagccgcagg

SEQ ID NO: 67161 - DNA, 201 bp, Homo sapiens; identical to SEQ ID NO: 47908

SEQ ID NO: 67162 - DNA, 201 bp, Homo sapiens
cagccccgtctctcttgcctttacttcactcctgcctgccaccagcccccaaactcatgcatacacacacccacacactcacacacactcccaccccctayaccctttccagtttaagtccagatgctctgaagctgctgagggggaacgttgaacagaggaaccggggggcatggtgccaggttcaaggagcatggagca

SEQ ID NO: 67163 - DNA, 201 bp, Homo sapiens
gtgccctagagccggcgcttccctgccttcctccagctacccctcactgctcatcatctcaccctcaggacatccagcgcttcatcctccgatccctgggrgagaagaggcagctctactatgccatggagcacctggggaccagcttcaaggatcctgtgagtcactccacttctgcccatctcacccctccgcactccc

SEQ ID NO: 67164 - DNA, 201 bp, Homo sapiens
cagcgcttcatcctccgatccctgggggagaagaggcagctctactatgccatggagcacctggggaccagcttcaaggatcctgtgagtcactccacttytgcccatctcacccctccgcactcccaggagggatggcactttggtttgcaacagagttttccatttttccaccatgaggcttggagaagagtctgccat

SEQ ID NO: 67165 - DNA, 201 bp, Homo sapiens
ttgataacaaaatatagaaagctctgttactgctgcttttatttctcttcttgtagttatgagaggaaactgcggggcggaggttatctatggctaggacyagggcatcaagcaggcgttctcagtcttcctggcgctactgatattttggatctgacattttggataattctttgttggggcagagggcagggcctgtcc

SEQ ID NO: 67166 - DNA, 201 bp, Homo sapiens
tttattttcccccctcttgctcttctttgaactctccagctaaggtatgtttgcaccagtgtttgaaagaaccggcagctgaacttgtctgccagtgggargggggctcttggagttagctgtctggcctctggagaccaccttctccagcactgcctctgccccaaggatcaatgtgctctaagtattcatcccccaacc

SEQ ID NO: 67167 - DNA, 201 bp, Homo sapiens
gctctaagtattcatcccccaacccctgaccttgtcgctccctctccagtgggcaatctgtcccaggctatagaaaatgtcctgagtgtcctgctcttctrcccggaggatgaggctgccaagagggctctgaaccagtaccaggcccagctgggagagccgagacctggcctcggacccagagaggtaatcccctctcca

SEQ ID NO: 67168 - DNA, 201 bp, Homo sapiens
ttcccttgctcttggcctgcccccttcattctgcctgtcctgattatccaaccgggactgtgcttaccactgcctctcagctgtggataagttccgtctcrtcttaatttagctgacataggtggatgttctttacaaatgaattttgctagaaattgataggaagaacaaaacaaaaaacatgaaggcataaaaatggat

SEQ ID NO: 67169 - DNA, 201 bp, Homo sapiens; identical to SEQ ID NO: 43092

SEQ ID NO: 67170 - DNA, 201 bp, Homo sapiens; identical to SEQ ID NO: 39116

SEQ ID NO: 67171 - DNA, 201 bp, Homo sapiens; identical to SEQ ID NO: 41949

SEQ ID NO: 67172 - DNA, 201 bp, Homo sapiens; identical to SEQ ID NO: 38156

SEQ ID NO: 67173 - DNA, 201 bp, Homo sapiens
tagtgactcaagcctgtaatcccagcactttgggaggccgaggcaggcggatcacctggggtcaggagttcgagaccagcctgaccaatgtggtgaaaccytgtctctactaaaaatacaaaaattagccgccgtggtggcccatgcctgtagtcccagctactcaggaggctgagacaggagaattgcttgaacccggga

SEQ ID NO: 67174 - DNA, 201 bp, Homo sapiens
taaggttttttcttttgtagcatatggtttataagtggaacccatttaaaaagcaaaatattggccaggcgcagtggctcatgcctgtaatcccagcactktgggaggctgaggtgggtggattgcttgagctcagaggtttgaaactagcctagacaacatggcaaaaccccgtctctataaaaaatacaaaaactagtt

SEQ ID NO: 67175 - DNA, 201 bp, Homo sapiens
aggtgttatgtgctgccttgccacacagataagacttgtcaatctctacattgagaatatgttccatcttaaccgtgttccatataaccaggctcatgacrtatattgcttctgtggagtttaaagtgtgtgacaaatctaatgctgcataagacatgccatacaaaaaggatgtttagtagtgtatttggggctgttcat

SEQ ID NO: 67176 - DNA, 201 bp, Homo sapiens
ttcttttgtagcatatggtttataagtggaacccatttaaaaagcaaaatattggccaggcgcagtggctcatgcctgtaatcccagcactttgggaggcygaggtgggtggattgcttgagctcagaggtttgaaactagcctagacaacatggcaaaaccccgtctctataaaaaatacaaaaactagttgggcaatgg

SEQ ID NO: 67177 - DNA, 201 bp, Homo sapiens
tcgtaggctttccgcaatatcagtggggaagttagactagcgttcagcttctgtgcgtttctcctttcatgagcttcaattattctctagaggagaaggckcacggtaacagctcctcactgtcccgtactacttctcatcctctgccccagaatacagactatatgctgagggtatagatcctagtgtccacttactgtc

SEQ ID NO: 67178 - DNA, 201 bp, Homo sapiens
aaaaattagccgggcgtggtggcgggcgcctataattacagctactggggaggctgaggcaggagaatcgcttgaacccaggaggtggaggttgcagtgarccgaggtcatgccactgcactccagcctgggcaacaagagtgaaactccatttcaaaagtaaataaataaataaaataatgatagtaataataattgaca

SEQ ID NO: 67179 - DNA, 201 bp, Homo sapiens
agggaatattttgatgttgaactatagtagcacataatttaaggtagtaaatgtccgtcatcaccatcagtttctatatattttggagatcgctgtacccygctacccttatttttcttgctcatcatttaggcagaaagaatccaggggccaagcacagtggctgagccctgtaatctcagctttggcaggctgaggtgg

SEQ ID NO: 67180 - DNA, 201 bp, Homo sapiens
gacaaatctaatgctgcataagacatgccatacaaaaaggatgtttagtagtgtatttggggctgttcatttgaagaggacttttaaggtcgtagacttartatattgagtatccacagaggcatatacatactctgttttttttgcttggtcagggtggaatgcatgtcaatggcgcacctcctctgatgcaagcttcta

SEQ ID NO: 67181 - DNA, 201 bp, Homo sapiens
caggtgactagtggataccatacaggacattacagatatagaacatttctatcatcgtaaaaagatctattggacagtgctggtctagactttccacctgrtgattcagagtccagctctacaagaattgataatgaagcaagtggatcgtttgtttcctgattcctagtctaataattccactgacatgttctctctccc

SEQ ID NO: 67182 - DNA, 201 bp, Homo sapiens
cattagtcattcctgtcactcttttcaggaatttttgaagttagcgtatttttctcttttaaccttttgtttctgaaatgacttgttaaaagaagtcaatrtgcctagttctctaacttaggttaacattgtccttccatgtgatcatgatccccagctttcctctgagaacagaaaatacactctcactttcctccacag

SEQ ID NO: 67183 - DNA, 201 bp, Homo sapiens
cagccaaatatgataatgggatccttaggtaaaattaatacacagctagaaagtatatatcttaggtggaggaaatagtagatttcttacgttaaatcctrtatgtctaattataagaacagggaaagggacagtaaagtgaaagagcatagtaaaacttccaagttaacaagggggaaaatggaatgagtggaaacaaaa

SEQ ID NO: 67184 - DNA, 201 bp, Homo sapiens
ttaaaatttggcttttttcctaaatgataatatcacagtatttgaaatgcctctttcttctcttgcctgccatgaccaaggtttttttgtgccatgcaaawactaatgataaagagcctcttgaatattacatttctcagaggggaatggctctaaatcactatcagtttctaagtcataagtattaaacctgaatctgct

SEQ ID NO: 67185 - DNA, 201 bp, Homo sapiens
gagctcatgttcttatgcattgttctgcaaactcatacatataatgaatattcgttgattcctccctaattatgaaccaaataacgaaattctagaatacrtggatttatatctctgtagcttttcttccatctatttggtgttattttcttgttagtattcatagactacatcagctctttgttggatgtttacttactg

SEQ ID NO: 67186 - DNA, 201 bp, Homo sapiens
aaaaaaagttttaaaaaatatttctgtgaggctgtcagagatataaggttatttatgttacagtgggcccaattaaagcatggcaatgttagcaggaaccytgtatgtgtgtaacatttgttcctgacacttggttctgctctccagattggtatacgatagagagacaggaaagccaaagggttatggcttctgtgaata

SEQ ID NO: 67187 - DNA, 201 bp, Homo sapiens
gctttccgcaatatcagtggggaagttagactagcgttcagcttctgtgcgtttctcctttcatgagcttcaattattctctagaggagaaggctcacggyaacagctcctcactgtcccgtactacttctcatcctctgccccagaatacagactatatgctgagggtatagatcctagtgtccacttactgtcctctcc

SEQ ID NO: 67188 - DNA, 201 bp, Homo sapiens
tgggaccacctcatcagggtccacccatgcaccatgtccctggccatgagagccgaggaccacccccacatgaactgaggggagggccattacccgagccyagacctctaatggcagaaccaagaggacccatgctagatcagaggggtccacccttggatggcagaggtaaggggagatcacattgcaaatgccataatg

SEQ ID NO: 67189 - DNA, 201 bp, Homo sapiens
tttgactgtgagagacccagcggtggatcgttctctacgttctgtgttcggtgagaggaattcgttgtagtcaagcttcggggagggactcccctctgcaycttctatctcatgaatcgctaccggagccgctgacggttcggacgtgcagttctccctgcttatcctgtagggcgtccaacctggtggactcatgagcaa

SEQ ID NO: 67190 - DNA, 201 bp, Homo sapiens
tgcgcccggccagcttggttttattcattttagggagacatgagtcatcaatcaaatacatttaagaaatacattggtttggttcagaaaggcaggacaaygcaaagccggggcttccacgctataggtaaatttaaatactttctggttgacagttggttgagtttatctgaaggccggggatcaatggaaagaaaatgt

SEQ ID NO: 67191 - DNA, 201 bp, Homo sapiens
gtaaatgaatgtgtttacaaattacaagtaccaagaataagatgcattttgttctttgaaacagggtcttgctctgtcacccaggctgaagtgcagtggtrcaatcctagctcactgcagcctcaacctctcaggcaatcctcccacctcagcctcctgagtagctgagactacaggtgcacgctactacatccagctaat

SEQ ID NO: 67192 - DNA, 201 bp, Homo sapiens
actcccttttcaacacataaggtaacattcaatacaaatacctaatgtaacaggtcatctttaaaataaattgtttcctgccagcagaggtgtgctaaatmatcatcatcatcatcatcatcatcataatttatgagagatttggggctttcccaccttcttctttaattcaagattgctgtcccatacatcatcgataat

SEQ ID NO: 67193 - DNA, 201 bp, Homo sapiens
ctacaggcgcccgccaacacgcccggctaattttttgtatttttagtagagacggggtttcaccgtgttagccaggatggtctcgtgatccgcccgcctckgcctcttaaaatgctgggattacaggcgtgagccaccgcgcccggccagggacactttcatcacatatccatatggcttactctctcatttctattcaga

SEQ ID NO: 67194 - DNA, 201 bp, Homo sapiens
tggtggctcatgtctgtaattccagcactttggaaggccgaggtggctggatcacctgaggtcaagagttcgagaccagcctggccagcatggtgaaaccycatctctactaaaaatacagaaaattagtcgggcatggtggcagacgcctgtaatcccagcttctctggaggctgaggcaggagaattccttgaacccag

SEQ ID NO: 67195 - DNA, 201 bp, Homo sapiens
ggacccataaagcacaagcatttttccaaaggtaattttcaaggccagggcaagtaagtttctaagtcttagttttataaaactcttttttcaaagaaaawgacttacaataagaaaccgaagattcacaccactctccatattgcacaaaagagaaaaaagattgatatttttgtcaatatcgaccatttgacactttac

SEQ ID NO: 67196 - DNA, 201 bp, Homo sapiens
acctccagggaggtatgactccagtgccagattggtgctgggggaagaaaacaacaagaggaagcagctggcaccaaaaataaaccagtacacactaaaakgaataatttccttttcattggaaaaatggcccattccaggtctggggcacagaaatgtccaataaaaataaatctggacttaaggagatcattttttaaa

SEQ ID NO: 67197 - DNA, 201 bp, Homo sapiens
aggtatgactccagtgccagattggtgctgggggaagaaaacaacaagaggaagcagctggcaccaaaaataaaccagtacacactaaaaggaataatttscttttcattggaaaaatggcccattccaggtctggggcacagaaatgtccaataaaaataaatctggacttaaggagatcattttttaaaattattttat

SEQ ID NO: 67198 - DNA, 201 bp, Homo sapiens
tgtaatagaaccctgcttttatttgaaatagccatgtgttcaatttaaaaactcactttcccatcctcatttgcacttgtgctggtcatgtgacgctgctyttagcaataagatgaaggtggtggtttctgagggtagtgtccttttcagaataaaaagacaaagcttatttgccttcttcttcctttactttatattcct

SEQ ID NO: 67199 - DNA, 201 bp, Homo sapiens
ttcattggaaaaatggcccattccaggtctggggcacagaaatgtccaataaaaataaatctggacttaaggagatcattttttaaaattattttattttwttattattattattattattattattattattattattattatttgagatagagtcttgctctgtcacccaggctggagtgtagtggcatgatctcagct

SEQ ID NO: 67200 - DNA, 201 bp, Homo sapiens
gaaaaatggcccattccaggtctggggcacagaaatgtccaataaaaataaatctggacttaaggagatcattttttaaaattattttattttattattawtattattattattattattattattattattattatttgagatagagtcttgctctgtcacccaggctggagtgtagtggcatgatctcagctcactata

SEQ ID NO: 67201 - DNA, 201 bp, Homo sapiens
aaaatggcccattccaggtctggggcacagaaatgtccaataaaaataaatctggacttaaggagatcattttttaaaattattttattttattattattattattattattattattattattattattattatttgagatagagtcttgctctgtcacccaggctggagtgtagtggcatgatctcagctcactataac

SEQ ID NO: 67202 - DNA, 201 bp, Homo sapiens
ttggcatggatgtggtgaaaagggaacacttctacactgctgatgggagtgtaaagtaaatgcaaacgcatttaccactacagaaaacagtgtagagattmcttaaagaactaaaaatagaactaccattccatctagcaatcccactactgggtatctacccaaaggaaaagaagtcattatatgaaaaagacacctgca

SEQ ID NO: 67203 - DNA, 201 bp, Homo sapiens
caatgactggataaagaaaatgtggtatatatgcaccatggaatactactcaaccataaaagggaacgaaataatggcatttgcagcaacttggatggagygggaggccattattctaagtgaagtaatttaggaatggaaaacgaaatattgtatgttctcacttataaatgggagctaagctatgaggatgcaaaagca

SEQ ID NO: 67204 - DNA, 201 bp, Homo sapiens
cacttataaatgggagctaagctatgaggatgcaaaagcataagaatgatacaatagactttggactttggagactcaggaaaaggtgggaggggagtgarggataaaagactatagatcgggcaccgtgtacaatgctcaagtgacagttgcaccaaaatctcagaaatcaccactaaagaaagtatccatgtaagcaaa

SEQ ID NO: 67205 - DNA, 201 bp, Homo sapiens
gaaatcaccactaaagaaagtatccatgtaagcaaaaccacctgttccccaagaactattgaaataaaataaaatattttaaaaatgagtccatcaatgcrgcaaacttttttgttgtctgatttgaagaagttgccacatccactccagccttcagcaaccaccactcagatcagtcagaagtcatccatgttgaggcaa

SEQ ID NO: 67206 - DNA, 201 bp, Homo sapiens
caggttggaatgcagtggcacgatctccacttactgcaacctccacctcccgggttcaagagattctcctgcctcagcatccgaagtagctgggactacargcatgtgccaccacaccaggctaattttttttgtatttttagtagagacagggtttcaccatgttggtcaggctggtctcgaacttctgacctcaaatga

SEQ ID NO: 67207 - DNA, 201 bp, Homo sapiens
ccaataatgttctttatagaaaaagaagattctctggtctgggatccaatctaggttcacacagtacatttagttgtcatgtctctttggtctcaatctgyaacaattccttagtttttctttgtctttcatgatgttgacagtttaaaattttgtcttttggattatgtgatgttttgaattttgtaacatgtccctcaa

SEQ ID NO: 67208 - DNA, 201 bp, Homo sapiens
cgaagtagctgggactacaggcatgtgccaccacaccaggctaattttttttgtatttttagtagagacagggtttcaccatgttggtcaggctggtctcraacttctgacctcaaatgatctgcccacctcggcctcccaaagtgctggggttacaggcgtgagccaccgcgcctggacaaagatgttacttgctttttt

SEQ ID NO: 67209 - DNA, 201 bp, Homo sapiens
acctcaaatgatctgcccacctcggcctcccaaagtgctggggttacaggcgtgagccaccgcgcctggacaaagatgttacttgctttttttttgagacrgagttttgctcttgttgcccaggctagagtgcaatggtgtgatctcggctcactgcaacctccgcttcccgggttcaagcgattctcctgcctcagcttc

SEQ ID NO: 67210 - DNA, 201 bp, Homo sapiens
caggcgtgagccaccgcgcctggacaaagatgttacttgctttttttttgagacggagttttgctcttgttgcccaggctagagtgcaatggtgtgatctyggctcactgcaacctccgcttcccgggttcaagcgattctcctgcctcagcttccccagtagctgggattacaggcacctgccaccacgcccaactaatt

SEQ ID NO: 67211 - DNA, 201 bp, Homo sapiens
gttggtgtcctcaaccagtaaccattttatgagtctcaactcagtggggagtatatatgaaaaaattatttttcctcaaatcagtgctttcaaccatattmtactaaatccccttttcctatactttaacaacatgctggacagatatcatgattttccatttagattcctcactttcagtgtgaaaactgagttcagtcc

SEQ ID NO: 67212 - DNA, 201 bp, Homo sapiens
atgctccttatcaaactttcactgactagttgtagtatcaattaattacatttaaaaatttaaagaagggccgggtgtggtggctcacgcctgcactccaycctgggcgacaagagcaagactctgtctcaaaaaaaaaaaaaaaatttaaagaagaaacattgttttaaacttagattcaaacatcagtttgctacttat

SEQ ID NO: 67213 - DNA, 201 bp, Homo sapiens
tcctaaactcagacttcgcctcctgtattgcacctgaaagcacctgtaagtaccatctggccctccctatgttgccttatgggaattggggctcagggaayccaagctctgaagtcaccttggctgctgcttttactgtgaatacacgtctttgtctctgactcagagatctcctgttttctaacacgatgtatataaaaa

SEQ ID NO: 67214 - DNA, 201 bp, Homo sapiens
tgtggtggctcacgcctgcactccatcctgggcgacaagagcaagactctgtctcaaaaaaaaaaaaaaaatttaaagaagaaacattgttttaaacttarattcaaacatcagtttgctacttatcagctgtgtgaccttagggcaactcaccagatggctctgagcctcagtttcctcatgtgtagattgtagataata

SEQ ID NO: 67215 - DNA, 201 bp, Homo sapiens
gacgactgtctgtgaatcttcagcactcctacatgtttcgctcctgtgtgccaggattatctttctaggaatgcctagtgcaagcaggcagccctggagarataaagacaaggacttcccctgaagcaaatgtatttacattcctagataaataaagatcaaaacggtaactttcaccgagagatttacagacatctttcc

SEQ ID NO: 67216 - DNA, 201 bp, Homo sapiens
gctgtcccatacatcatcgataattatgctttctgctgacatagtcagattcaacactttaagtttgtcacacacattgttttgatattgagtgcttgatwtggaaattcttacaactgaaagtgttggaaaggatgagatttttaaaaggaaaatgaaggggaatgtccaaaaggagaagtttaagggaaaaaaaacttc

SEQ ID NO: 67217 - DNA, 201 bp, Homo sapiens
ggagcccctttctgggctggccaaggccggagcccactcccttagcttgcagggaggtgtggagggagaggcacgagcgggaaccggggctgcctgcggcrcttgcgggccagctggagttccgggtgggcgtgggcttggtgggccccgcactcgggcagccagtcagccctgctggccccaggtaatgggggacttagc

SEQ ID NO: 67218 - DNA, 201 bp, Homo sapiens
cctgggctcccagtttggtggcatttgaggatcccttcagcccccccactgcactgtgggagcccctttctgggctggccaaggccggagcccactccctyagcttgcagggaggtgtggagggagaggcacgagcgggaaccggggctgcctgcggcgcttgcgggccagctggagttccgggtgggcgtgggcttggtg

SEQ ID NO: 67219 - DNA, 201 bp, Homo sapiens
agagaataggctgtaaaatgtttcttatcagactgaattctgtgttgatattaatgccggagaggtataacaaggcatgtctgaccacccccttccatcayggcccgaaccagtctttcaggttaaattttaaaagtgccctggccaggagaaagtccattcagatggttggggggccttagaattttatttttggtttag

SEQ ID NO: 67220 - DNA, 201 bp, Homo sapiens
ctgaggcgggggaattgcttgaacctgggaggcggaggttgcagggaggcggaggttgcagggaggcggaggttgcagtgagccgagattgcgccactgcmctccagcctgggcgacactgcgagactctgtctcaaaaaaaaaaaaaaaaaaaaaaaaatttagtattagctatagggtttttttaaaaagtaggtctat

SEQ ID NO: 67221 - DNA, 201 bp, Homo sapiens
tgtggttaagaacttccccttatgccaggatgttgctcagaagggactgtcctaacttaggcacaggcggaataaatcaacctaagtgtccttggcccagmtcatcatagtgtcattaacatgacatttttgtggttttagccccttggtgggtttcacttaggcactcgtgggtaacaaccaagatggagtcactctggc

SEQ ID NO: 67222 - DNA, 201 bp, Homo sapiens
cttagctcccatttgtaagtgagaacacacaatatttggttttccattcctaagttacttcacttagggcctcccactccatccagttgctgcaaatgccrttatttcattcctttttatggttgagtagtattccaaggtgcatatataccacattttctttatccagtcgttggttgatgggcacttaggttggttcca

SEQ ID NO: 67223 - DNA, 201 bp, Homo sapiens
tgcctggcctcttctagcatttttgtgctttcaggtcttagatttaagtggtttttttttgtttgtttttgtttttgtttttgacagtctcactctgtccscaggctggagtgcagtggcgtgatcttggctcactgcaacctctgcctcccgggttcaagcgattctcctgcctcagcttccccagtagctgggattaca

SEQ ID NO: 67224 - DNA, 201 bp, Homo sapiens
ggggtttcaccgtgttagccaagatggtctcgatctcctgaccttgtgatctgcctgccttggccttccaaagtgctgggattacaggtgtgagccaccgygcccggcctagcatatatattaaaattggatgttacgaagaagattagcatgcctcctgtgaaaggatgacatgctgacgtggaaattcgtgctccatat

SEQ ID NO: 67225 - DNA, 201 bp, Homo sapiens
gcctggcctcttctagcatttttgtgctttcaggtcttagatttaagtggtttttttttgtttgtttttgtttttgtttttgacagtctcactctgtcccmaggctggagtgcagtggcgtgatcttggctcactgcaacctctgcctcccgggttcaagcgattctcctgcctcagcttccccagtagctgggattacag

SEQ ID NO: 67226 - DNA, 201 bp, Homo sapiens
tcaccatgttggccaggctggtctcaaactcctgactttaggctatccgcctgcctcggcctcccaaagtgctgggattacaggcgtgagccaccgcgccyggccaaagatgttattttctataaaggcaaccgttagaaccttcaactcattatttttaggctgacaaaaacatctgttattattatactacactatgta

SEQ ID NO: 67227 - DNA, 201 bp, Homo sapiens
ggagtgaaagtttaataaatgaaagaagaaagctatctatagtggagaggggagcccaagtgggctgccgtttttacagtttaatttaaaaggtttttggkttgtttgtttgtttgtttgtttgtttgttttttgagatgaagtcttgctctcgtcccccaggctagagtgcaatggtgcgatcttggctcactgcaacct

SEQ ID NO: 67228 - DNA, 201 bp, Homo sapiens
ccaccgcgcccggccaaagatgttattttctataaaggcaaccgttagaaccttcaactcattatttttaggctgacaaaaacatctgttattattatacyacactatgtattgtgaatagtttattttacaagcataatagagtattttgaaattacactctgctagaaccccttgctagttgttaattttacctagaaa

SEQ ID NO: 67229 - DNA, 201 bp, Homo sapiens
gggtgacagagcaagatctgtctcaaaaaaaaaataaataaataaaataaaataaaatataaaaaaaagagatgagaaacaaatgatcagatttgcagagyaatctttcaagaatttatcctatttacacatgcagaaatgtcaattacaacattactatcagggcaacaaattatcaagtaaagctaccaatcagaatta

SEQ ID NO: 67230 - DNA, 201 bp, Homo sapiens
tgtgccatgagcacctgcctcctgggtaaagatctgcaccatagattgtcacgtgggaggaatgtgccttgtgcaaccagactcctgtaagaactccgggwcctcagacctaagtggacttacgtgggcagagacatctcatatatgttcgtataatttgtagtcgtgccaaaagcaccttactgtgaccagcatggaggg

SEQ ID NO: 67231 - DNA, 201 bp, Homo sapiens
taaagcacaagcatttttccaaaggtaattttcaaggccagggcaagtaagtttctaagtcttagttttataaaactcttttttcaaagaaaatgacttayaataagaaaccgaagattcacaccactctccatattgcacaaaagagaaaaaagattgatatttttgtcaatatcgaccatttgacactttacaaaatca

SEQ ID NO: 67232 - DNA, 201 bp, Homo sapiens
aatcccatcctttacttgggtaccccaattacccaaagttggccaattagtgctgcagtctgtttcctttgggttgagaagtattttcagtattgtcccayttgtggttcatgagaaagatgttatcagaccccaacacttaaccaaagttagcctttgagttgggagtttccacactatagtcccctctgggtcgtcaga

SEQ ID NO: 67233 - DNA, 201 bp, Homo sapiens
tcttttttcaaagaaaatgacttacaataagaaaccgaagattcacaccactctccatattgcacaaaagagaaaaaagattgatatttttgtcaatatcraccatttgacactttacaaaatcagatattttgaatatgtgttatatctcagaaagacatcctcctctctgtgctataggggagaggagcatatccttta

SEQ ID NO: 67234 - DNA, 201 bp, Homo sapiens
ttgtaaaagtcaaagaagcagtttatgacctgccactctgcttagcacccaatatcaaactggcaaggctcaaacttgccccctgttgggccccatcatcrttaatccaacctctgaccagagagttttgacttgtgatctctgggaaagatggttaccctgagtaatagaaaaaataagaaagggaaaggagagagagaa

SEQ ID NO: 67235 - DNA, 201 bp, Homo sapiens
aattgaacaatttgtaaaagtcaaagaagcagtttatgacctgccactctgcttagcacccaatatcaaactggcaaggctcaaacttgccccctgttggrccccatcatcattaatccaacctctgaccagagagttttgacttgtgatctctgggaaagatggttaccctgagtaatagaaaaaataagaaagggaaag

SEQ ID NO: 67236 - DNA, 201 bp, Homo sapiens
taataataactgaaatacagagcctatagcattatttttccacaatatgtaatcacatatttataaatctgaaaataaaagaaatatcattagaatgtcastctgtacaaatttatggcaatatgcacaaaatacactaaaagctgccttatttttatgcagttgcatgctcacatatatatttctgtaacagacaatttt

SEQ ID NO: 67237 - DNA, 201 bp, Homo sapiens
taggaagcctaattacctttaaattgtacaacattttttgcataaattattttcatatttttatgacttacacagaccatttatgacatgcttggactttyggacttgtcctaaacatacctcttgtcaaacaaccattttactttagaacaagaatttaccatacaagatcctttgttatataaaatctttttctttata

SEQ ID NO: 67238 - DNA, 201 bp, Homo sapiens
ttcttgaaacattaagttttctgtctccagtttcccatttttattaaagacaaattatggtaacaccaacttgctttattatacttggcctgattgtttgyataaagtgtagcaagaataattatttttcacataagctttttgtaaattggaactctgttccatagaaggaatcttagataagatttttttagatccgag

SEQ ID NO: 67239 - DNA, 201 bp, Homo sapiens
cttctttatgctgaataggggcaatgatattcctgcctaactattagggtcttttgtgtttacggtagagaggagcttagttagaaagcattggcctgggygcagtgactcacgcctgtaatcccagcactttgggaggccgaggtgggcagatcacctgaggtcaggagtttgagaccaacctggccaacgtggtgaaac

SEQ ID NO: 67240 - DNA, 201 bp, Homo sapiens
gctgctggttgcccatttttatggctatttcttaatatgctaaacaaggggtgggttattcatgcctctcatttttagaccatatataataactttctgaygttgtcatggcatttgtaagttgtcatggcactggtgggagtgtagcagtgaggatgaccagaggtcactcttggtaccatcttggttttggtgggtttt

SEQ ID NO: 67241 - DNA, 201 bp, Homo sapiens
attaaagtgagaacaatgtattaagaaagtaaaggagtgaaagaatgggtactctatagacagcagccccaagggctgctggttgcccatttttatggctrtttcttaatatgctaaacaaggggtgggttattcatgcctctcatttttagaccatatataataactttctgacgttgtcatggcatttgtaagttgtca

SEQ ID NO: 67242 - DNA, 201 bp, Homo sapiens
tccttgacagtaaagacttagtttcattcactgatacagccctagacctagaccaacacctgttgtatatactagacactcaaaaaatatgtgttgaatgyatgaatggttatagtatgtaaaaaaatcccacaaaggatttacacagaattgtaaataataactgtattaggttaagaaccttggaaaataaagaacaag

SEQ ID NO: 67243 - DNA, 201 bp, Homo sapiens
caaggtttgtgagtgcaccaattgacactctgtatctagctgctctggttgggccttggagaacctttatgtctagctcagggattgtaaatacaccaatyggcactctgtatctagctcaaggtttgtaaacacaccaatcagcaccctgtgtttagctgaaggtttgtgagtgcaccaatcgacactctgtatctagct

SEQ ID NO: 67244 - DNA, 201 bp, Homo sapiens
gcatacctagtaggttacagtatagtgtaagcataacttttacatgcactgggaaaccaaaaaatttgtgtgacttgctttatcacaatattcactttatdgcagtggtctagaacaaaacctgatatcacaaaacctgatattcctgatatatgggcttatctctgaagtatacctgtatctcagtgaagatgttattat

SEQ ID NO: 67245 - DNA, 201 bp, Homo sapiens
cttgagcccaggagtttaagacaagcctgggttacatagtgagaccccatctctacaaaaaataaaaaattagctgggcatagtctcagctactcaggagrctgaggtgggaggattgcttgagccctgaaggtggaggcagcagtgagctgtgattgtaccactgcgctcgaggcttgaggacagagcaaaacactgact

SEQ ID NO: 67246 - DNA, 201 bp, Homo sapiens
agcctcctaagtgctgggattacaggcatgaaccaccacacctggccaattgaccgaatattttaatcccactgttgagacctactgctccaaaaaaaaascttcctttcaaaatattactactcatggacaatgttcctggtcacccaagagctctgatggagatgtacaagaaggttaatgttgttttcatgcatccta

SEQ ID NO: 67247 - DNA, 201 bp, Homo sapiens
aattagctgggcatagtctcagctactcaggagactgaggtgggaggattgcttgagccctgaaggtggaggcagcagtgagctgtgattgtaccactgcrctcgaggcttgaggacagagcaaaacactgactcaaaaaaaaaaaaaaaaaaaaaagaaagaaagtctacatccaatagccagaagtatgtctctaaggt

SEQ ID NO: 67248 - DNA, 201 bp, Homo sapiens
acaggtgcataccaccatgcctggctaatttttttatatttttggtagagtcagggttttgccatgttgcccaggctggtcttgaactcctgagctcaacmaatccacctgcctcagcctcctaagtgctgggattacaggcatgaaccaccacacctggccaattgaccgaatattttaatcccactgttgagacctact

SEQ ID NO: 67249 - DNA, 201 bp, Homo sapiens
aaagatatggaaccaacctaagtgcccatcaatcaatgactggataaagaaaatgtggtatatatgcaccatggaatactactcaaccataaaagggaacraaataatggcatttgcagcaacttggatggagtgggaggccattattctaagtgaagtaatttaggaatggaaaacgaaatattgtatgttctcacttat

SEQ ID NO: 67250 - DNA, 201 bp, Homo sapiens
tcaattaaggctcagatgattgttagcattttttcagcaataaagtattttataattagtgtatttatgttgcacatttatgacataatgttattgcatayctagtaggttacagtatagtgtaagcataacttttacatgcactgggaaaccaaaaaatttgtgtgacttgctttatcacaatattcactttatggcagt

SEQ ID NO: 67251 - DNA, 201 bp, Homo sapiens
actcaatatattgattgggttctaatcctaaaatactgatttttatactgtccaaagaaagtttgcaatcaaaacaaaggtcagaagagataagtaaaggmcagccagagagcaagattttgcactgattagctctcactattcagagtccagagaaatttactatagtggacacaaatactctagttgttccatagttat

SEQ ID NO: 67252 - DNA, 201 bp, Homo sapiens
ttggttatcctggtattcatggaatctcatcaattctggattcattcacaattttgaattttcacgcctgagaactggggaccagactataagttgataaytcttaacattttcacctctgagcccttgcccaagtagccaaatgatctcaagatatgtctgtttcagttagcctttgttgtataacaaatcacctctagc

SEQ ID NO: 67253 - DNA, 201 bp, Homo sapiens
gatatatgggcttatctctgaagtatacctgtatctcagtgaagatgttattatttatttatttatttgagacagagtctcactgtgtcacccaggttggratgcagtggcacgatctccacttactgcaacctccacctcccgggttcaagagattctcctgcctcagcatccgaagtagctgggactacaggcatgtgc

SEQ ID NO: 67254 - DNA, 201 bp, Homo sapiens
gaggcacaagaatcgcttgaactcaggaagtggaggttgcagcgaacaaccactgcactccatcctgggtgacagagcaagatctgtctcaaaaaaaaaataaataaataaaataaaataaaatataaaaaaaagagatgagaaacaaatgatcagatttgcagagcaatctttcaagaatttatcctatttacacatgca

SEQ ID NO: 67255 - DNA, 201 bp, Homo sapiens
gcaccagaccctgccaaaatgaaacaaaacaagaactggcaaaatgattgtttctaatataagccaggaaattgtttcacaggtcaagaatgaggaaaactttttttttttttcctaagatcttacctcttattgtctttaggagttcctgtttattattgaggtcatgtgttttgttaccaggtcaactagcttactcct

SEQ ID NO: 67256 - DNA, 201 bp, Homo sapiens
caccagaccctgccaaaatgaaacaaaacaagaactggcaaaatgattgtttctaatataagccaggaaattgtttcacaggtcaagaatgaggaaaactttttttttttttcctaagatcttacctcttattgtctttaggagttcctgtttattattgaggtcatgtgttttgttaccaggtcaactagcttactcctg

SEQ ID NO: 67257 - DNA, 201 bp, Homo sapiens
tatttataaatctgaaaataaaagaaatatcattagaatgtcactctgtacaaatttatggcaatatgcacaaaatacactaaaagctgccttatttttaygcagttgcatgctcacatatatatttctgtaacagacaattttactttgatgtgacaggagataatcgatcttgaagttaaagataataaatttgggtgt

SEQ ID NO: 67258 - DNA, 201 bp, Homo sapiens
gacaattttactttgatgtgacaggagataatcgatcttgaagttaaagataataaatttgggtgtgactaaggtgtataaatttcagttgatctatatakatttatagcaagatggttaaaatgtgaggttgctcatcagaggcatagggttatcttaattatctctgatatgtaaatcatttacttttcacaaaaggcc

SEQ ID NO: 67259 - DNA, 201 bp, Homo sapiens
taaagataataaatttgggtgtgactaaggtgtataaatttcagttgatctatatagatttatagcaagatggttaaaatgtgaggttgctcatcagaggyatagggttatcttaattatctctgatatgtaaatcatttacttttcacaaaaggccctctttcttgtgtaaacacaaacaaccataaattaaaataagta

SEQ ID NO: 67260 - DNA, 201 bp, Homo sapiens
gagttcctgtttattattgaggtcatgtgttttgttaccaggtcaactagcttactcctgcactgatgatcctggaatgaaagttttttttattgaaagtytatttgcagccaggtgtggtggctcacacctgtaatcccagcactttgggaggttgaggcaaaaggatcccttgagcccaggagtttaagacaagcctgg

SEQ ID NO: 67261 - DNA, 201 bp, Homo sapiens
tgattgtaccactgcgctcgaggcttgaggacagagcaaaacactgactcaaaaaaaaaaaaaaaaaaaaaagaaagaaagtctacatccaatagccagargtatgtctctaaggtccttgaccttccaagtataatgcaaaacacagaagagattgttttagaatgataaatttgactactaagcaaaaaattatgcatg

SEQ ID NO: 67262 - DNA, 201 bp, Homo sapiens
tcatttgcacttgtgctggtcatgtgacgctgcttttagcaataagatgaaggtggtggtttctgagggtagtgtccttttcagaataaaaagacaaagcytatttgccttcttcttcctttactttatattcctctttctgccaggaatataaatgtgactctgtggtgtcacgcgcatccgtgtgaagagaccaccaaa

SEQ ID NO: 67263 - DNA, 201 bp, Homo sapiens
accttagggcaactcaccagatggctctgagcctcagtttcctcatgtgtagattgtagataataatatttttatcataaaattgatgtgggtaatacatrtaaagtacttagcagagcgattaccatttattttatttcactagtttttacggaaattctttaaattttagtagtgtgtaggaagagatcatctttgtcc

SEQ ID NO: 67264 - DNA, 201 bp, Homo sapiens
ctgccacagtggatatgttgatgaaaagagtcaaactctgttaaatatttgaagagatttattctgagccaaatatgagtgaccatggcccatgacacagscctcaggagattctgagaatatgcgcccaaggtggtcggggcacagcttgggtttttttttttttttttttttgagacggagtctcgctctgtcacccag

SEQ ID NO: 67265 - DNA, 201 bp, Homo sapiens
tatgtatatatacacatgcgtgcatgtatgtatatatgcacatgtgcgtgcacgtatgtatatatgtacatgtgcgtgcacgtatgtgtgtatgcacataktgtgtgtgtgtgtgtgtgtgtgtgtgtgtatttttttgagacagagtctcgttctgttgcccaggctgcagtgcagtggcgtgatctcggcccactgcaa

SEQ ID NO: 67266 - DNA, 201 bp, Homo sapiens
taagggtctggagagtcatggcctacaaactataaattctcatcagatgggtttgatttaaccctatatatcgtgacttactttccaatctgactctggcrtaacattatgtgacaaagaagaaagtcaaaatattttaccccaaaacatgtttctttgccatattttgaaatggccctgcacagctgtcctttggagggg

SEQ ID NO: 67267 - DNA, 201 bp, Homo sapiens
ctcttagtgactttaacttttggtgaaaaccttggtaagttcagggttttaattaggtatggagccgaggacagcagacagaagtgcagataaggtctgatttttttttagcatttacgtgtcccaggccttacctagctgtaaagcaggaaagttttacagttacaagttatagtggcattttatgacacatttaggaag

SEQ ID NO: 67268 - DNA, 201 bp, Homo sapiens
gtttcaccatgctggccaggctggtctcgaactcccgacctcaggctatccgcctgcctcggcctcccaaagtgctgggattatagatgtgagccaatgcractggcctaagtgctgggattacgggagtgagccgctgcgcctggcctaagtgctggggtacaggcgtgagccaccaggccagcgaagtctccacaatct

SEQ ID NO: 67269 - DNA, 201 bp, Homo sapiens
cattgcagtacagcaggagaaaatgatgtcagcttgccccattattggtggtattaactttgattaactgttttcactgtcacattactatttttcttttktaattaattagtggtaattaattgtgttatgataagatgctccttatcaaactttcactgactagttgtagtatcaattaattacatttaaaaatttaaa

SEQ ID NO: 67270 - DNA, 201 bp, Homo sapiens
caggagaaaatgatgtcagcttgccccattattggtggtattaactttgattaactgttttcactgtcacattactatttttcttttgtaattaattagtrgtaattaattgtgttatgataagatgctccttatcaaactttcactgactagttgtagtatcaattaattacatttaaaaatttaaagaagggccgggtg

SEQ ID NO: 67271 - DNA, 201 bp, Homo sapiens
cccatgtctactaaaaatacaaacattagctgggcgtggtggtgcatatctgtaatctcagctattcaggaggctgaggcatgagaatcacttgaacccaggaggcggaggttgcagtgagctgagactgcaccactgcactccagcctgggcaaaaagagcgaaattccatctcaaaaaaaaaaaaaaagcagacggtaa

SEQ ID NO: 67272 - DNA, 201 bp, Homo sapiens
agcaggtagtcattaactaaatatgtggtggcagggagcttatcaggcagagcaaatagcatattctaaggaaatgagggagaaagttacataactttttytttcttttttttttttgagacagggtctcattctgttgtccaggctggagggcagtggtgcaatcatggtcagctggagccttaaactcctgggctcaag

SEQ ID NO: 67273 - DNA, 201 bp, Homo sapiens
atcagtttgctacttatcagctgtgtgaccttagggcaactcaccagatggctctgagcctcagtttcctcatgtgtagattgtagataataatatttttmtcataaaattgatgtgggtaatacatgtaaagtacttagcagagcgattaccatttattttatttcactagtttttacggaaattctttaaattttagta

SEQ ID NO: 67274 - DNA, 201 bp, Homo sapiens
aaacattgttttaaacttagattcaaacatcagtttgctacttatcagctgtgtgaccttagggcaactcaccagatggctctgagcctcagtttcctcaygtgtagattgtagataataatatttttatcataaaattgatgtgggtaatacatgtaaagtacttagcagagcgattaccatttattttatttcactagt

SEQ ID NO: 67275 - DNA, 201 bp, Homo sapiens
aggtggccagatttcaggctcagatccagaatggtgataagggtaccttcccttacagaaagaagataacatatagaatagcaacagctgatgtcaaaaarcctcttttcttttttaaaatagcggtgagtaactattactggaatggaatagataaacctaaatagaggtaaaggggtaatcccaggactcaggcttgcc

SEQ ID NO: 67276 - DNA, 201 bp, Homo sapiens
tctgaatgaataatcatttgttaaaagattccccacatcatttttcttacttttcttgctgtgtgctaggcattattctagctaaaaggaatacactggtraacaagactaataaggtccctgcctctatggagttgacatttgggatagaggtgggtgttggagatggacaataaacacgtgaatacataattacatatt

SEQ ID NO: 67277 - DNA, 201 bp, Homo sapiens
ggatgcgacttcatcaccagattgacctatcaagtgcaaggaaacttggcttcaggagaggctaacttacttctgtgtagtgtagggggaaaagagaaaamacacacacacacacacacacacacacatgtgcgcgcacgcacagcggtaaagcagaagtttccagctgggttttctgtccctttggccacataatcaagt

SEQ ID NO: 67278 - DNA, 201 bp, Homo sapiens
gggcgacagagccagactaagtctcaaaaaaaaagaaaaaagaattcaaagccaatgtaactagagggcaaaaaagaaagaaaaatgatgtggggaatctmtgaatgaataatcatttgttaaaagattccccacatcatttttcttacttttcttgctgtgtgctaggcattattctagctaaaaggaatacactggtga

SEQ ID NO: 67279 - DNA, 201 bp, Homo sapiens
gctcctgaaaggagaaattggatgaatgttggtgccattcaatgggatattcaagtggaaatgttaaatgtgcagttgaatataggcgctcaggccgggcrcggtggctcacgcctgtaatcccagcactttgggaggccgaggtgggtggatcatatgaggtcaggagtttgagactagtctggctaacatggtgaaccc

SEQ ID NO: 67280 - DNA, 201 bp, Homo sapiens
tgaggctagagaatgacttgaacccaggaggcttgaacccaggagccgagatcgtgccactgcactatagcctgggtgacagagtgagactccgtctcaaaataataataataataataataataataataataataataataataataaaaggaaaataggagctcagaggctgggcacggtggcttgtgcctgtaatcc

SEQ ID NO: 67281 - DNA, 201 bp, Homo sapiens
gaggctagagaatgacttgaacccaggaggcttgaacccaggagccgagatcgtgccactgcactatagcctgggtgacagagtgagactccgtctcaaaataataataataataataataataataataataataataataataataaaaggaaaataggagctcagaggctgggcacggtggcttgtgcctgtaatccc

SEQ ID NO: 67282 - DNA, 201 bp, Homo sapiens
ccaatatcaaactggcaaggctcaaacttgccccctgttgggccccatcatcattaatccaacctctgaccagagagttttgacttgtgatctctgggaargatggttaccctgagtaatagaaaaaataagaaagggaaaggagagagagaaaagccttgcctgtggcaggatggggaaggtgaagatctcagggagttg

SEQ ID NO: 67283 - DNA, 201 bp, Homo sapiens
aggctagagaatgacttgaacccaggaggcttgaacccaggagccgagatcgtgccactgcactatagcctgggtgacagagtgagactccgtctcaaaataataataataataataataataataataataataataataataataaaaggaaaataggagctcagaggctgggcacggtggcttgtgcctgtaatccca

SEQ ID NO: 67284 - DNA, 201 bp, Homo sapiens
ataataataataataataaaaggaaaataggagctcagaggctgggcacggtggcttgtgcctgtaatcccagctgtctgggaggccgaggccagtagatygcttgagctcgggagtttgagaccagtctgggcaacatggcaaaaccccttctctacaaaaaaatacaaaaattagctggtgcttggtggctcatgcctg

SEQ ID NO: 67285 - DNA, 201 bp, Homo sapiens
tttgagaccagtctgggcaacatggcaaaaccccttctctacaaaaaaatacaaaaattagctggtgcttggtggctcatgcctgtagtcccagacacttsggaggctgaggtgggaggatggcttgagcactggaagtcaaggctgcaatgagccatgatcgcaccattgcactccagcttgggtgacagagtgagaccc

SEQ ID NO: 67286 - DNA, 201 bp, Homo sapiens
tgcaatgagccatgatcgcaccattgcactccagcttgggtgacagagtgagaccctctaaaaaaaaaggaaaataggagctcagaggagaactggggacrtatttatccacaggtggtaatcagagccatggatgtggttaataacctggccaacgtggtgaaaccccgttgctaattaaaaaatacaaaaattggccgg

SEQ ID NO: 67287 - DNA, 201 bp, Homo sapiens
ttggctcactgcaacctctgcctcccaggattaagcgattctcgtgcctcagcctcccaactagctgggattacaggcatgcgccaccataccctgctaatttttttttttttttttagtagagacgggtttccccatgttggctgggctggtctcagactcttggccttaagtgatctgcctgccttggcctcccaaagt

SEQ ID NO: 67288 - DNA, 201 bp, Homo sapiens
cttcacctcttttcaggaggggatacaaataatctgtagctttatttatttacttatgcgacagagtcttactctgttgcccaggctggagtgcagtggcrtgatctcagctcactgcaacctccacctcctgggttcaagcgattctcccacctcagcctcccaagctgggattagcccgccaccatgcctagctaactt

SEQ ID NO: 67289 - DNA, 201 bp, Homo sapiens
tcacagaatgctgctgagagttaaggaatacgaggattgaaaaacagccactggatggaaagacaaaggggtcattgatagcgttgggaagagtcattttrggggagtggatgaagctagattgcagtgtcaagggaataagtacaagtgacagggagtgtagatgactgtgagaaacgtagacataaaagggaagagaga

SEQ ID NO: 67290 - DNA, 201 bp, Homo sapiens
gtttttctttgtctttcatgatgttgacagtttaaaattttgtcttttggattatgtgatgttttgaattttgtaacatgtccctcaatttggctttgttrgatatttccttgtgattagattcagattttgcatttttggcaaaaaactatataagagctattatgaccatctcattgcagtacagcaggagaaaatgat

SEQ ID NO: 67291 - DNA, 201 bp, Homo sapiens
agacaaaggggtcattgatagcgttgggaagagtcattttgggggagtggatgaagctagattgcagtgtcaagggaataagtacaagtgacagggagtgkagatgactgtgagaaacgtagacataaaagggaagagagataggccacagactcatccctccataaataacagttttgttattactatttactagtcatt

SEQ ID NO: 67292 - DNA, 201 bp, Homo sapiens
ttatcttactggcagatctgcaggtcagctgataattgtgcctcagactgacactcagatgcctaggctctggggttcaggttgtgctcatatctgtttcstgagtcttattctgggacccaggctgaagaagcagtgctggtgggacatgttgttcttatgaacaatggcaggactaggagagctatgtcaaaccaagag

SEQ ID NO: 67293 - DNA, 201 bp, Homo sapiens
cagtggcacgatctcggctcactgcaagctctgcctcccaggttcacactattctcctgcctcagcctccggagtagctgggactacaggcgcccgccacygcgcccggttaattttttatatttttagtagagacgggttttcaccatgttagccaggatggtctcgatctcttgaccttgtgatccacccgcctcggcc

SEQ ID NO: 67294 - DNA, 201 bp, Homo sapiens
ttagctgccttcccacggggcagggctcgggacctgcagcccgccatgcctgagcctcccaccccctctgtgggctcctgtgcggcccgagcctccccgaygagcaccaccccctgctccaaggcgcccagtcccatcgaccacccaagggctgaggaatgcgagcaaacggcgcaggactggcaggcagctccacctgca

SEQ ID NO: 67295 - DNA, 201 bp, Homo sapiens
atccagaatggtgataagggtaccttcccttacagaaagaagataacatatagaatagcaacagctgatgtcaaaaagcctcttttcttttttaaaatagyggtgagtaactattactggaatggaatagataaacctaaatagaggtaaaggggtaatcccaggactcaggcttgcctctcttatagcattataattact

SEQ ID NO: 67296 - DNA, 201 bp, Homo sapiens
agccaagtcaaacatattcaaggtctctctcctgtctttccattagtagtacatttgccagagcaagtcacagggccaggcccaagaagtataatcttccyacagtagaagggagaggggagtggatattcattgaacaataagccaaactactgatcaacctatcaatcatgctcatgttattaggttggtgtacagatc

SEQ ID NO: 67297 - DNA, 201 bp, Homo sapiens
atgttgcccagtctggttctcgaactcctgggcataagtgatccacctgcttcggcctcctaaagtgctaggattacaggtgtgagccactgtgcccagcsttaattaattattttaacattaattttatttttttaaaaaataagcaggccaggcatggtggcccatgcctgtaatcccagcactttgggaggccgaggc

SEQ ID NO: 67298 - DNA, 201 bp, Homo sapiens
cagccttaattaattattttaacattaattttatttttttaaaaaataagcaggccaggcatggtggcccatgcctgtaatcccagcactttgggaggccraggcaggcagatcatctgaagtcaggagttcgagaccagcctggccaacatggtgaaaccccatctctactaaaaatataaaaatcagccgggcgtggtg

SEQ ID NO: 67299 - DNA, 201 bp, Homo sapiens
ctgaggcaggagaatcgtttgaacccgggaagtggaagttgcagtgagccgagatctcgccactgtactccagcttggtgacagagcgagactccgtctcaaaaaaaaaaaaagcaatacatccaaatgcttcaaaattcagaaagaggccaggcacggtggctcacacctgtaatctcagcactgtgggaggccaaggca

SEQ ID NO: 67300 - DNA, 201 bp, Homo sapiens
gcgagactccgtctcaaaaaaaaaaaaagcaatacatccaaatgcttcaaaattcagaaagaggccaggcacggtggctcacacctgtaatctcagcactktgggaggccaaggcaggcggatcacctgaagtcaggagttcgagaccagcctggccaacatggtgaaactccatctatactaaaaatacaaaaattagcc

SEQ ID NO: 67301 - DNA, 201 bp, Homo sapiens
tgcttcaaaattcagaaagaggccaggcacggtggctcacacctgtaatctcagcactgtgggaggccaaggcaggcggatcacctgaagtcaggagttcragaccagcctggccaacatggtgaaactccatctatactaaaaatacaaaaattagccgggtgtggcgatgcacacctgtaatcccagctactcgggaag

SEQ ID NO: 67302 - DNA, 201 bp, Homo sapiens
cactgtgggaggccaaggcaggcggatcacctgaagtcaggagttcgagaccagcctggccaacatggtgaaactccatctatactaaaaatacaaaaatkagccgggtgtggcgatgcacacctgtaatcccagctactcgggaagctgaggcaggagaatcacttgaacctaggaggcggaggttgcggtgagccgaga

SEQ ID NO: 67303 - DNA, 201 bp, Homo sapiens
aatacaaaaattagccgggtgtggcgatgcacacctgtaatcccagctactcgggaagctgaggcaggagaatcacttgaacctaggaggcggaggttgcrgtgagccgagatcgtgccactgcactccatcctgggcaagggggagactctgtctcaaaaaaaaaaaaattcagaaagaactaaaagttcagtgaaagtt

SEQ ID NO: 67304 - DNA, 201 bp, Homo sapiens
gcgatgcacacctgtaatcccagctactcgggaagctgaggcaggagaatcacttgaacctaggaggcggaggttgcggtgagccgagatcgtgccactgyactccatcctgggcaagggggagactctgtctcaaaaaaaaaaaaattcagaaagaactaaaagttcagtgaaagtttacttttcaccgtattcctgaac

SEQ ID NO: 67305 - DNA, 201 bp, Homo sapiens
gctgaggcaggagaatcacttgaacctaggaggcggaggttgcggtgagccgagatcgtgccactgcactccatcctgggcaagggggagactctgtctcaaaaaaaaaaaaattcagaaagaactaaaagttcagtgaaagtttacttttcaccgtattcctgaacccctagtttccttcctggggcagctgtactttat

SEQ ID NO: 67306 - DNA, 201 bp, Homo sapiens
tcctgaacccctagtttccttcctggggcagctgtactttatttaaccaggagcctagtgatgaacatttgcttgttaacagtcttctattatgaatgaarcaatggataatcttgtatatgtcattttgtgcatacgtgagtgtcttcagtctatttccctagaagctgagactggtggagcttcgtaggcaagtgattt

SEQ ID NO: 67307 - DNA, 201 bp, Homo sapiens
ttttgacgttagtccttgattttgattcaacagaagcagccacttttggcatcttgttatagatgcacaggtggtaattgaagccatgagagttaaccaawatataaagaactgcagacagctgagaaggagtgctatcttcgtcctttattaagagtcagctattggccaggcgcagtggctcacgcctgtaatcccagc

SEQ ID NO: 67308 - DNA, 201 bp, Homo sapiens
agtacaaaaaattagctgggcgtgctggcgggcgcctgtagtcccagctactcgggaggctgaggcaggagaatcatttgaacctgggaggcagaggttgyagtgagccaagattgcaccactgcactggtgacagagtgagattccatctcaaaaaataaataaaaagtcagctattagcaccttcggaggctgaggtgg

SEQ ID NO: 67309 - DNA, 201 bp, Homo sapiens
gacagagtgagattccatctcaaaaaataaataaaaagtcagctattagcaccttcggaggctgaggtgggcagatcacctgaggtcaggagttggagacyagcctggccaacatggtgaaaccctctctctactaaaaatacaaaaattagctggatatggtggtgcatgcctgtaatcccagctactcaggaggctgag

SEQ ID NO: 67310 - DNA, 201 bp, Homo sapiens
ggtgaggacgtggagagtctttatatctagctcagggattgtaaatgcaccaatcagcaccctgtgtttagctcaaggtttgtgagtgcaccagtctacastctgtatctagctgctctggtgaggacgtggagagtctttatatctagctcagggattgtaaatacaccaatcagcaccctgtgtttagctcaaggtttg

SEQ ID NO: 67311 - DNA, 201 bp, Homo sapiens
tccagaattgccatgtgaaatgtgtgaaggacaagatgttctgtgtttggtaaatgtgtatgaggaagagagaaacaattagaagttctctgtcacacaayctacacactaccaggaagttattctagaaaaaataacgttctctaaaacgaaccatgcaatctgacacccgtcttccacctctcagggaagagaaacttc

SEQ ID NO: 67312 - DNA, 201 bp, Homo sapiens
tctgtgtttggtaaatgtgtatgaggaagagagaaacaattagaagttctctgtcacacaatctacacactaccaggaagttattctagaaaaaataacgytctctaaaacgaaccatgcaatctgacacccgtcttccacctctcagggaagagaaacttcaaaggcaggaggcagggccaatgcatgatgtgttctatt

SEQ ID NO: 67313 - DNA, 201 bp, Homo sapiens
attagaagttctctgtcacacaatctacacactaccaggaagttattctagaaaaaataacgttctctaaaacgaaccatgcaatctgacacccgtcttcyacctctcagggaagagaaacttcaaaggcaggaggcagggccaatgcatgatgtgttctattgtcccaaggagacctgcctgagccttgaccctagtttc

SEQ ID NO: 67314 - DNA, 201 bp, Homo sapiens
agtctagagtagaggtgagcaaactttttctgtaaagagcagatggtggctgggcaccgtggctcacgcctgtaatcccagcactttgggaggctgaggcmggcagatcacctgaggtcagcagttcaagaccaacctggccaacatagcaaagccccatgtctactaaaaatacaaacattagctgggcgtggtggtgca

SEQ ID NO: 67315 - DNA, 201 bp, Homo sapiens
agagtccggtgagagcaccaaagatcaaaaaaaagatgcagtaaatgggagggaaggagggcagaagggatacccatgtgttactgaagtcaacttttatytattctgaagttttgcactatagtctgtgggaaatacattttctctgtattactgagtgttcctgcaaactcaggctcttgaaccacagatattaatcta

SEQ ID NO: 67316 - DNA, 201 bp, Homo sapiens
ttgtggcacggtaacttgttagcttgcaagtagcagaaaatctcagacttttcagtttctgacttcacaagaaggaattaagaaaagtcaggaaaaatgtraataaactgaggtatctgtcccatccgaaagtgaccgggtgactctcttagtttaagaggatttatggaactgaaggcagaaatctgagaggccaggtag

SEQ ID NO: 67317 - DNA, 201 bp, Homo sapiens
gagatttattctgagccaaatatgagtgaccatggcccatgacacagccctcaggagattctgagaatatgcgcccaaggtggtcggggcacagcttgggtttttttttttttttttttttgagacggagtctcgctctgtcacccaggctggagtgcagtggcgtgatctctgctcactgcaagctccacctcccaggtt

SEQ ID NO: 67318 - DNA, 201 bp, Homo sapiens
agatttattctgagccaaatatgagtgaccatggcccatgacacagccctcaggagattctgagaatatgcgcccaaggtggtcggggcacagcttgggtttttttttttttttttttttgagacggagtctcgctctgtcacccaggctggagtgcagtggcgtgatctctgctcactgcaagctccacctcccaggttc

SEQ ID NO: 67319 - DNA, 201 bp, Homo sapiens
gatttattctgagccaaatatgagtgaccatggcccatgacacagccctcaggagattctgagaatatgcgcccaaggtggtcggggcacagcttgggtttttttttttttttttttttgagacggagtctcgctctgtcacccaggctggagtgcagtggcgtgatctctgctcactgcaagctccacctcccaggttca

SEQ ID NO: 67320 - DNA, 201 bp, Homo sapiens
tttttttttgagacggagtctcgctctgtcacccaggctggagtgcagtggcgtgatctctgctcactgcaagctccacctcccaggttcacgccattctyctgcctcaagcctcccgagtagctgggactacaggtgcctgccactgcgcctggctaattttttgttttagtagagacggggtttcaccgtgttagccag

SEQ ID NO: 67321 - DNA, 201 bp, Homo sapiens
acattcctggaggtaaaattgctggatgaagtcaacactattagttgcctatttaaaaaatatccccctctacacatacacacacacacacacacacacayacaccccattttttgtaatagaaccctgcttttatttgaaatagccatgtgttcaatttaaaaactcactttcccatcctcatttgcacttgtgctggtc

SEQ ID NO: 67322 - DNA, 201 bp, Homo sapiens
agccagtcagccctgctggccccaggtaatgggggacttagcacgcgggccagtggctgcggagggtgtactgggtcccccagcagtgctggcccaccggygctgcgctcgatttctcgccgggccttagctgccttcccacggggcagggctcgggacctgcagcccgccatgcctgagcctcccaccccctctgtgggc

SEQ ID NO: 67323 - DNA, 201 bp, Homo sapiens
ccctgctggccccaggtaatgggggacttagcacgcgggccagtggctgcggagggtgtactgggtcccccagcagtgctggcccaccggcgctgcgctcratttctcgccgggccttagctgccttcccacggggcagggctcgggacctgcagcccgccatgcctgagcctcccaccccctctgtgggctcctgtgcgg

SEQ ID NO: 67324 - DNA, 201 bp, Homo sapiens
cacgcgggccagtggctgcggagggtgtactgggtcccccagcagtgctggcccaccggcgctgcgctcgatttctcgccgggccttagctgccttcccayggggcagggctcgggacctgcagcccgccatgcctgagcctcccaccccctctgtgggctcctgtgcggcccgagcctccccgacgagcaccaccccctg

SEQ ID NO: 67325 - DNA, 201 bp, Homo sapiens
gctctggtgaggacgtggagagtctttatatctagctcagggattgtaaatgcaccaatcagcaccctgtgtttagctcaaggtttgtgagtgcaccagtstacagtctgtatctagctgctctggtgaggacgtggagagtctttatatctagctcagggattgtaaatacaccaatcagcaccctgtgtttagctcaag

SEQ ID NO: 67326 - DNA, 201 bp, Homo sapiens
ctctggtgaggacgtggagagtctttatatctagctcagggattgtaaatgcaccaatcagcaccctgtgtttagctcaaggtttgtgagtgcaccagtckacagtctgtatctagctgctctggtgaggacgtggagagtctttatatctagctcagggattgtaaatacaccaatcagcaccctgtgtttagctcaagg

SEQ ID NO: 67327 - DNA, 201 bp, Homo sapiens
tctcgtgatccgcccgcctcggcctcttaaaatgctgggattacaggcgtgagccaccgcgcccggccagggacactttcatcacatatccatatggcttrctctctcatttctattcagataccaccttgacagcggagctgtcccagactacccttgtgtaaagcagtatttccacacccctcccctggactacctgtc

SEQ ID NO: 67328 - DNA, 201 bp, Homo sapiens
ttgtatacttcaggccgtggcctcatctttaatacgctatactgagcttctttatacaatagtctcagggcagaattctaagagcaagagcagaagccagragaccttttcaaaatgaaattcagaagtcatcacttctccattttattggtcaaagtcacaagaccagcccaagattcaagaggtgggtaaatagacttc

SEQ ID NO: 67329 - DNA, 201 bp, Homo sapiens
tctgtctcaaataaataaataaataaataaaaataaaaaaaataaattagccaataacatagtagcttaaaacaacaataaacacaaattccccagggtcrttatggtgggatgcgacttcatcaccagattgacctatcaagtgcaaggaaacttggcttcaggagaggctaacttacttctgtgtagtgtagggggaaa

SEQ ID NO: 67330 - DNA, 201 bp, Homo sapiens
attttaaacagcacatgacaaatcttgctgcccttctatccgctaaaggtaaaaaaccaaacgtccataattctccaaaggcaaagatagagtttttccartacagatgtaagtcagcctattatccacacattcccaacaaatggcctttaagagcctttggtgccaaattcaacaaatggaagggttttacacaggtta

SEQ ID NO: 67331 - DNA, 201 bp, Homo sapiens
agacttcctgctgagagagaaggcagttagaggctggttaggcagatagagagggagggtctctggagaagggcagtgttcacaagaacgctagcaggacmgtacctacaccgcctctgcagctaatgggaagaaatgtggttaagaacttccccttatgccaggatgttgctcagaagggactgtcctaacttaggcaca

SEQ ID NO: 67332 - DNA, 201 bp, Homo sapiens
tcagatccagaatggtgataagggtaccttcccttacagaaagaagataacatatagaatagcaacagctgatgtcaaaaagcctcttttcttttttaaartagcggtgagtaactattactggaatggaatagataaacctaaatagaggtaaaggggtaatcccaggactcaggcttgcctctcttatagcattataat

SEQ ID NO: 67333 - DNA, 201 bp, Homo sapiens
agtttggtcgacatggtgaaaccctatctctattaaaaatacaaaaagaattagccgagcgtggtggcacacgcctgtaatcccagctacttgggaagctraggcataagaattgtttgatcctaggaggccagatcatgtcactgcactgcagccttggcaacagaatgagactctgtcaccaaagaataaattaataca

SEQ ID NO: 67334 - DNA, 201 bp, Homo sapiens
ggaaggccgaggtggctggatcacctgaggtcaagagttcgagaccagcctggccagcatggtgaaacctcatctctactaaaaatacagaaaattagtcrggcatggtggcagacgcctgtaatcccagcttctctggaggctgaggcaggagaattccttgaacccaggaggtggaggttgcagtgagccgagatcact

SEQ ID NO: 67335 - DNA, 201 bp, Homo sapiens
ctttcatatttatgtgatacctttcacgattgatgccattcacttcttttttttttgagacagaatctcactctgttgcccaggtaagagtgcagcagcamgttattggctcactgcaacctctgcctcccaggattaagcgattctcgtgcctcagcctcccaactagctgggattacaggcatgcgccaccataccctg

SEQ ID NO: 67336 - DNA, 201 bp, Homo sapiens
acgattgatgccattcacttcttttttttttgagacagaatctcactctgttgcccaggtaagagtgcagcagcaagttattggctcactgcaacctctgsctcccaggattaagcgattctcgtgcctcagcctcccaactagctgggattacaggcatgcgccaccataccctgctaatttttttttttttttttagta

SEQ ID NO: 67337 - DNA, 201 bp, Homo sapiens
agagctgtaacaccgcgagggtccgcagcttcattgttgaagtgagaccaagaacccaccaattccggacacattggtactcttgaaaaaaaaaatctccygcagtactaaaagctaataattcattgatgactaattttgacttagtttactttccttataacaactagctgagatgagctactctaaaagtataggatg

SEQ ID NO: 67338 - DNA, 201 bp, Homo sapiens
gttcatgcctaatcctgtcacccatagctgtcagcaaagagtgcaaggcagattatttgaaagagaatagcagttaatagtgtcaaacccattcttagccragaaggactttactgagagaggcctctaactccctaaatcttagaagggataactcttctaatttgggcctctaacccaaggttggttaagcgttcttgc

SEQ ID NO: 67339 - DNA, 201 bp, Homo sapiens
aagatctgcagcttcactcctgagccagcgagaccacgaacccaccagaaggaagaaactccaaacacatctgaacatcagaagggacagactccagacgygccaccttaagagctgtaacaccgcgagggtccgcagcttcattgttgaagtgagaccaagaacccaccaattccggacacattggtactcttgaaaaaa

SEQ ID NO: 67340 - DNA, 201 bp, Homo sapiens
ttgggaaggtgaggcacaagaatcgcttgaactcaggaagtggaggttgcagcgaacaaccactgcactccatcctgggtgacagagcaagatctgtctcaaaaaaaaaataaataaataaaataaaataaaatataaaaaaaagagatgagaaacaaatgatcagatttgcagagcaatctttcaagaatttatcctatt

SEQ ID NO: 67341 - DNA, 201 bp, Homo sapiens
cctctaaaattagtagcctataatggcatctgtttattgttcatatttctgtgggttgaaatttggactggaatcagctgagtggtgcttctgctgatctyccctggaaccacttgacttgtcatctctctaagatggtcttttgtttacatacgtagcacttggtgctatcaacttgtatacttcaggccgtggcctcat

SEQ ID NO: 67342 - DNA, 201 bp, Homo sapiens
ctgctgatctcccctggaaccacttgacttgtcatctctctaagatggtcttttgtttacatacgtagcacttggtgctatcaacttgtatacttcaggcygtggcctcatctttaatacgctatactgagcttctttatacaatagtctcagggcagaattctaagagcaagagcagaagccagaagaccttttcaaaat

SEQ ID NO: 67343 - DNA, 201 bp, Homo sapiens
gcttctctggaggctgaggcaggagaattccttgaacccaggaggtggaggttgcagtgagccgagatcactgcattgcactccagcctgggcgacagagygagactctgtctaaaaaaaaaaaaaaaaaattgtggcacggtaacttgttagcttgcaagtagcagaaaatctcagacttttcagtttctgacttcacaa

SEQ ID NO: 67344 - DNA, 201 bp, Homo sapiens
aacactcttgtttgtaagatttagtaggccgggtgctggtggctcacgcctgtaatcccagcactttgggaggccgaggtgggcggatcacgaggtcaagwgatggagaccatcctagccaacactgtgaaaccctgtctctactaaaaatacaaaaattagctgggcgtagtggcatgcacctgtagtcccagctactcg

SEQ ID NO: 67345 - DNA, 201 bp, Homo sapiens
tgttgccacttgctagtgttgaaaaagcctcctgcttcaggttcactatcagcatgaatgaagaaaaggtggccagatttcaggctcagatccagaatggwgataagggtaccttcccttacagaaagaagataacatatagaatagcaacagctgatgtcaaaaagcctcttttcttttttaaaatagcggtgagtaact

SEQ ID NO: 67346 - DNA, 201 bp, Homo sapiens
atggatcagtagaatcaatattgcgaaaatgaacatactgccaaaagcaatctgcagattcaatgcaatttccatcaaaataccatcatcattcttcacakaactagaaaaaaagctgggcgcggtggctcacgcctgtaatcccagcactttgggaggcagaggtgggcagatcatgaggtcaggagatcgagaccatcc

SEQ ID NO: 67347 - DNA, 201 bp, Homo sapiens
gggcctaaagatgtgactgaattgcttcaatcacatgctaaaaaaagctttaatggatgaagagttgctttttatggatgagcaaagaaagtggtttcttragagggaatatattcctggtgaagatgctgtggatattgttgaaatgataatgaaggatttagaatattccataaatttagttgataaagcacctttaaa

SEQ ID NO: 67348 - DNA, 201 bp, Homo sapiens
gattgacccttggcaaaccctcggaaatgttcttaggatgttctttatgtcactaattgatgattttgttgtgtacacttggagcaatgtaccatgccatrctggcttgctaatttgctttgcacaaacattgagattgatgatgtacccctggtctcattgttgtgatcctgagttttggttgctatggctaatcgcata

SEQ ID NO: 67349 - DNA, 201 bp, Homo sapiens
acaattatctttgcaatctgagtttactccttattaaatttgttctcaattctttaggaagattgaattttagtgtataaatcctgttgacaaatgaggtwctagaatgatgagaattctctttaagaggccatttctgagataaatctacatagcaagtaggtctagttgctcagtccttacacctccaagggagcctgg

SEQ ID NO: 67350 - DNA, 201 bp, Homo sapiens
tacaggagtatacttaattgttaaaagctgtaaatagcttctattagtttagtccatgcagttaattcctgtttgatatttatgaacatttcagctttccrtgagtccgaaagttttttcctgtattttaatattacagtgttcaaaggtattagaaacctgaatttaagagcacctgttagagtcctatagctgattata

SEQ ID NO: 67351 - DNA, 201 bp, Homo sapiens; identical to SEQ ID NO: 42721

SEQ ID NO: 67352 - DNA, 201 bp, Homo sapiens; identical to SEQ ID NO: 43381

SEQ ID NO: 67353 - DNA, 201 bp, Homo sapiens; identical to SEQ ID NO: 43144

SEQ ID NO: 67354 - DNA, 201 bp, Homo sapiens; identical to SEQ ID NO: 41049

SEQ ID NO: 67355 - DNA, 201 bp, Homo sapiens; identical to SEQ ID NO: 43150

SEQ ID NO: 67356 - DNA, 201 bp, Homo sapiens; identical to SEQ ID NO: 43151

SEQ ID NO: 67357 - DNA, 201 bp, Homo sapiens; identical to SEQ ID NO: 40014

SEQ ID NO: 67358 - DNA, 201 bp, Homo sapiens; identical to SEQ ID NO: 41106

SEQ ID NO: 67359 - DNA, 201 bp, Homo sapiens; identical to SEQ ID NO: 42386

SEQ ID NO: 67360 - DNA, 201 bp, Homo sapiens; identical to SEQ ID NO: 40899

SEQ ID NO: 67361 - DNA, 201 bp, Homo sapiens; identical to SEQ ID NO: 40517

SEQ ID NO: 67362 - DNA, 201 bp, Homo sapiens; identical to SEQ ID NO: 37933

SEQ ID NO: 67363 - DNA, 201 bp, Homo sapiens; identical to SEQ ID NO: 40448

SEQ ID NO: 67364 - DNA, 201 bp, Homo sapiens; identical to SEQ ID NO: 40449

SEQ ID NO: 67365 - DNA, 201 bp, Homo sapiens; identical to SEQ ID NO: 39510

SEQ ID NO: 67366 - DNA, 201 bp, Homo sapiens; identical to SEQ ID NO: 40523

SEQ ID NO: 67367 - DNA, 201 bp, Homo sapiens; identical to SEQ ID NO: 42875

SEQ ID NO: 67368 - DNA, 201 bp, Homo sapiens; identical to SEQ ID NO: 40525

SEQ ID NO: 67369 - DNA, 201 bp, Homo sapiens; identical to SEQ ID NO: 40457

SEQ ID NO: 67370 - DNA, 201 bp, Homo sapiens; identical to SEQ ID NO: 40458

SEQ ID NO: 67371 - DNA, 201 bp, Homo sapiens; identical to SEQ ID NO: 41745

SEQ ID NO: 67372 - DNA, 201 bp, Homo sapiens; identical to SEQ ID NO: 40163

SEQ ID NO: 67373 - DNA, 201 bp, Homo sapiens; identical to SEQ ID NO: 43376

SEQ ID NO: 67374 - DNA, 201 bp, Homo sapiens; identical to SEQ ID NO: 43377

SEQ ID NO: 67375 - DNA, 201 bp, Homo sapiens; identical to SEQ ID NO: 43378

SEQ ID NO: 67376 - DNA, 201 bp, Homo sapiens
gggaggttcagactcttggagccagaggctgcatgacctctaaactgtaatttctttttttttttttttgagacagagtctggctctaccgcccaggctgragtgcaatggcgcgatctcggctcactgcaagctccgcctcccgggttcacgccattctcctgcctcagcctcccgagtagctgggactacaggcgcccg

SEQ ID NO: 67377 - DNA, 201 bp, Homo sapiens
acttgtttaagcattcaaatgtaactcatatcaagtatttatgacactttgtaatagtaaaatattgggcagatgccagaaagtaaggtggaaagcttatkttgataagcagtaaaaggactttattctcttggttctgtccattttgtctttctaaggaggagcccccaacctttgtggcaccagggactggcttcatgg

SEQ ID NO: 67378 - DNA, 201 bp, Homo sapiens
tcaaagaacagaagaagaccattagacatcccacagaggatttggatatcagaaatgttaaacattaggaatatctcaaaagatagcttgtatacagaatmtattttaaagaaaatttaaaatgtaacttattttataaatttgcttgttcactaaataatacatgagaatacttgttcaagaggatgggaagctaaaagt

SEQ ID NO: 67379 - DNA, 201 bp, Homo sapiens
aaagcttatgttgataagcagtaaaaggactttattctcttggttctgtccattttgtctttctaaggaggagcccccaacctttgtggcaccagggactkgcttcatggaagacaatttttccacagatggggtggggatggtgggatggcttcaggatgattcaagcatattacatttattgttcactttatttctatt

SEQ ID NO: 67380 - DNA, 201 bp, Homo sapiens
cttgttcactaaataatacatgagaatacttgttcaagaggatgggaagctaaaagtctatcacgattgttataaatttgctaacaactaatattttcctytaggaaacaagaagtagctcatgaggatgatttgactttcttcctcagatcatttcatgcatagataggggagatcctatactttctgtttattttctgc

SEQ ID NO: 67381 - DNA, 201 bp, Homo sapiens
gcatgatccttggcagcagtgccaatcctgagacggcagcacgtggtgaagggggtctcctgcaaagaaagctgagggtgagagtgggcaaaggaaatacmgtatagaaatctataaggatttattcaggagagattaaatgtattcagatcatctttacataaaatggtctctactctcatctcttttttttctctactt

SEQ ID NO: 67382 - DNA, 201 bp, Homo sapiens
ctttaggaaacaagaagtagctcatgaggatgatttgactttcttcctcagatcatttcatgcatagataggggagatcctatactttctgtttattttcygctgcttaaacagaattttgcagttaaataatttgtcagtgttcacatgtagctgaaagaaacagaactgaaacccaattctgtggcttcaattaaagtg

SEQ ID NO: 67383 - DNA, 201 bp, Homo sapiens
atgtagctgaaagaaacagaactgaaacccaattctgtggcttcaattaaagtgtaaaaaacataacaattcaccatcagtctaatgaaatatttacacartctttcatggtcacgttttgtatacaaagagcaggtgctattattattttgattccaataacttaacattaaaacgtcagccacaagctgagattcctcc

SEQ ID NO: 67384 - DNA, 201 bp, Homo sapiens
agttgagaagcctccattctcagtaacaactgtcttcggatgtcatgatactaagacccttcactttcttttgtcatctcaggccacatatgttcgacctragagctgctatcttcccagctggttgacgcctcagtacttggatgctcacttcttagtctcacgcttttactcccgaaccaacagcttcctgaagattgt

SEQ ID NO: 67385 - DNA, 201 bp, Homo sapiens
aggccacatatgttcgacctgagagctgctatcttcccagctggttgacgcctcagtacttggatgctcacttcttagtctcacgcttttactcccgaacsaacagcttcctgaagattgttccagaaccaaagcagcttgaatgtaatcaccagaaggttgttactgtgcattactccctaaacagtgaagcatatgagg

SEQ ID NO: 67386 - DNA, 201 bp, Homo sapiens
ttccagaaccaaagcagcttgaatgtaatcaccagaaggttgttactgtgcattactccctaaacagtgaagcatatgaggatgattccaatgtaaagttmttctatttggtaagtctcagtcagtgggttcctggaatcctgttcaattgcacgtctgcttagcccagcacagcttagaaatcatgcatcagtcatgcca

SEQ ID NO: 67387 - DNA, 201 bp, Homo sapiens
tgattccaatgtaaagttcttctatttggtaagtctcagtcagtgggttcctggaatcctgttcaattgcacgtctgcttagcccagcacagcttagaaakcatgcatcagtcatgccacggtgaccagagtaagggcagccttctcactttgctggtgaatactgttcgatccattaacaacaaacaaacacatagaacg

SEQ ID NO: 67388 - DNA, 201 bp, Homo sapiens
agaaagtccagtccatgaatactcaaagagaacaaaaagtatactattctctaatacaccccagcacaaaattgctacacattgctgatgcgagtatatgratggtgtagacacacaaggaaagctgagtaccactgatgttatttagtttgcaagctgggattacaggtcagaaagagttacatctggcattccatctcc

SEQ ID NO: 67389 - DNA, 201 bp, Homo sapiens
ttgttggttttttgttttttgcttttaaagcaaagcccactagagacagcaccacatatgtgactggtaaggcaacagcagaagaaaggagtccttttatyaggagtcttgacctaaaaagccaagtcctaataatgaaaaaacaatgagcaaagaaagaggaagaaaatggctgtgaaagaagagaggacagtggaaatg

SEQ ID NO: 67390 - DNA, 201 bp, Homo sapiens
agtggtaaacatggagagaactgagaggagatacagagaggtggaaggagaaggaagaaggagaggaaactctgcaagggaaacttgggcaaatgtctacrtttatttacttgtctgataaggaaatggtggagtataggaatggccaataatctaagacaaaaacaattagtgctagatacagaaatcaaaattgaagca

SEQ ID NO: 67391 - DNA, 201 bp, Homo sapiens
attgtattaaagtttattagagaacctgcttaaaaatacaaaataaaaatatagattacatagcctaaatgttagagatttcatttccatgagtctggggkggggagcctcagaaagtgtatttttaaagagcaccttattctattctaataatatccatattattctaataatattctaataatatccgtattattctaa

SEQ ID NO: 67392 - DNA, 201 bp, Homo sapiens
  misc_feature (1)...(201): n = A,T,C or G, or insertion/deletion polymorphism (see Tables 1-2)
ctacattcactagactgttgcttaattttaatttccagagcaggaatctaatttttagtgctccaaagaccttgtagtaatctaaatccgaaatcacttcngtaagatagcatgtggttcctgttctccttggttcatggttgaagcttctatttctaagaatgcaactcctctatttaaccaaagcagtgagaatttcta

SEQ ID NO: 67393 - DNA, 201 bp, Homo sapiens
aaatttgactacataataaaaatatagtaatgatgcaactgggctcattatcaaatgagccaagatatagagcatatacctagtttcttctgcccaaatcytacatcggtcttttctttcattttctgcaatttcattgctgatggtgcctttcttttcctttaagtcagtgttttgtagaatattcaaacatactttttc

SEQ ID NO: 67394 - DNA, 201 bp, Homo sapiens
agggagagatagtatgaaccagaaggggacatgaaggagttgttgtattggttcttggctggtttatacaagatttagtgcagacagtcattagtgactasagcagaatcagcctcattttaataattgtttttagagaaaaatcaagcagcttagaacaatgaaaatgtgattttactaggttcttgttcactagttttt

SEQ ID NO: 67395 - DNA, 201 bp, Homo sapiens
caagcagcttagaacaatgaaaatgtgattttactaggttcttgttcactagttttttgaaatagaccaagctgagtttaaaaaaaaatctaaaaaaaaargacaaattaagtaataaaaactaaatttgttgaacacagttgaagccatctgcattggaagtattacaaatagcaaacaaaaagggatagtactctaggt

SEQ ID NO: 67396 - DNA, 201 bp, Homo sapiens
aaatagcaaacaaaaagggatagtactctaggttcatttctcattattagaatctcatccaaatggttaacgtcttcccatggcacctttgggtaatatawtcattttcttcctatgaggaaatctcatgagaagctctacctctcttaatgcttgagttaatgttgcagcagtagctttcttcaataccatctcaatatt

SEQ ID NO: 67397 - DNA, 201 bp, Homo sapiens
agattcaattccatgaatttagaataacaagtaggcccttaattcaactgttatatttctcagttccaagaattctggacaaggtttatgaatcctgttcytatctccagacacattacgttttattagtgaatgaatgctgcaattagtgggaaggagcacttagcaacttggggagtgggcaaaggaccctatgtactc

SEQ ID NO: 67398 - DNA, 201 bp, Homo sapiens
gaaactctgcaagggaaacttgggcaaatgtctacatttatttacttgtctgataaggaaatggtggagtataggaatggccaataatctaagacaaaaamaattagtgctagatacagaaatcaaaattgaagcatttcaaaaagaggcaaccagcagtgtaaaacattgcaactgtcagagtgaagactgaccacgaat

SEQ ID NO: 67399 - DNA, 201 bp, Homo sapiens
aatcaaaattgaagcatttcaaaaagaggcaaccagcagtgtaaaacattgcaactgtcagagtgaagactgaccacgaatttgttgataaggaagttatkattcatctaagagggcatttttattatgttggagagacccaagggcaggattgcttactgagactgcagggtgtatgttgtgaaagagagagaagtaaat

SEQ ID NO: 67400 - DNA, 201 bp, Homo sapiens
gcaactgtcagagtgaagactgaccacgaatttgttgataaggaagttattattcatctaagagggcatttttattatgttggagagacccaagggcaggrttgcttactgagactgcagggtgtatgttgtgaaagagagagaagtaaatgaaaattcttgaaaactaggcagatgagtttcaatataatcaatagatat

SEQ ID NO: 67401 - DNA, 201 bp, Homo sapiens
taggcagatgagtttcaatataatcaatagatattcaaactttcagtcagaaatcagtatttgtttgggttgtcctaaatgtgtttatgtttctttgcttmataatagatttataattaacctcttcactcatctagaaaaaaaaccttgagttcatatattaacattatttttatttttatttcagtatccagtgatcac

SEQ ID NO: 67402 - DNA, 201 bp, Homo sapiens
ttaacattatttttatttttatttcagtatccagtgatcacccttcaggtaagataactaatagttgaagaattgttttctcattttttgaacatctctcyaaacctcaaaatcaaaaggcagctcacagggaagattgtctatttaaattgtcgcagaattattaatttcatgtagacagcctcaagaggacagaaatag

SEQ ID NO: 67403 - DNA, 201 bp, Homo sapiens
gatgctcaatgagaagaaaacatatcactccttctctgtggaagaatatggtaaataatagcaatgaaaatattacctatcaataaaaaaattataaaatmtttccaattttgcaagggcaagattattaaataatgaattttcaagtgagtatctcttcctttcctctttccttgtcctctgttactattttagggttct

SEQ ID NO: 67404 - DNA, 201 bp, Homo sapiens
  misc_feature (1)...(201): n = A,T,C or G, or insertion/deletion polymorphism (see Tables 1-2)
aatccgaaatcacttctgtaagatagcatgtggttcctgttctccttggttcatggttgaagcttctatttctaagaatgcaactcctctatttaaccaangcagtgagaatttctactgcaatcctttgacaatcatccttgattggaagcaccatggggaagtaaagggcttcttgaaaatcaaagcagctgcagcatt

SEQ ID NO: 67405 - DNA, 201 bp, Homo sapiens
caggccagatctgacccactggcatttattacattttctgctaaaggagccactctcaacctggaagagaggagatctgtggcaatcagatccagagagartgtggtctttgtacagactgataaacccacctacaagcctggacagaaaggtgagtgtacctaaatcaggttaccctcaactaatgtcacttatatgata

SEQ ID NO: 67406 - DNA, 201 bp, Homo sapiens
  misc_feature (1)...(201): n = A,T,C or G, or insertion/deletion polymorphism (see Tables 1-2)
tctaagaatgcaactcctctatttaaccaaagcagtgagaatttctactgcaatcctttgacaatcatccttgattggaagcaccatggggaagtaaaggncttcttgaaaatcaaagcagctgcagcattatcataactcccttattagttctcaccccccgaatgttgacttattattgtcaattaggccaaatatgat

SEQ ID NO: 67407 - DNA, 201 bp, Homo sapiens
gagaacctgcttaaaaatacaaaataaaaatatagattacatagcctaaatgttagagatttcatttccatgagtctggggtggggagcctcagaaagtgyatttttaaagagcaccttattctattctaataatatccatattattctaataatattctaataatatccgtattattctaataacattctaatcacatat

SEQ ID NO: 67408 - DNA, 201 bp, Homo sapiens
  misc_feature (1)...(201): n = A,T,C or G, or insertion/deletion polymorphism (see Tables 1-2)
tcttgaaaatcaaagcagctgcagcattatcataactcccttattagttctcaccccccgaatgttgacttattattgtcaattaggccaaatatgattanccaactccctgctttagtaataactacatttgcataagaacaggattaatggactgttccctcaaatatgggtcatagataagaagatcatttgtaccaa

SEQ ID NO: 67409 - DNA, 201 bp, Homo sapiens
aacatcacacaacaaggcctgtcgtgcagtggggagagggggagggatagcactaggagaaatacctaatgtaaatgacgagttaatgggtgcagcacagmaacatggcacatgtatacatatgtaacaaacctgcacgttgtgcacaagtaccctagaacttaaagtataataattaaaaataaaataaaatgtgatata

SEQ ID NO: 67410 - DNA, 201 bp, Homo sapiens
agtttcttctgcccaaatcttacatcggtcttttctttcattttctgcaatttcattgctgatggtgcctttcttttcctttaagtcagtgttttgtagartattcaaacatactttttccagaaagtttcatttgcatcaagaagtttcagatctttctttaaacttatcttaagacctggaactactagtcctctaaaa

SEQ ID NO: 67411 - DNA, 201 bp, Homo sapiens
aaattgagccaggagtcttacacaattgagagatattcagttttcaaaaaattgatcattacaatctgagattataatgctacaaatattcataatctacycagcatcatgcttctttttgaataaaaatatggtgtgatattaactatgattgctaaaacctcattgcacagtttattgttgcttcatatttataatgca

SEQ ID NO: 67412 - DNA, 201 bp, Homo sapiens
cagcatcatgcttctttttgaataaaaatatggtgtgatattaactatgattgctaaaacctcattgcacagtttattgttgcttcatatttataatgcartatattaactactatatagtggcatgaacaaaatatgaaaaagcatagtaaacagataaaatagaaagtgagaccagactaatatggtgatggtagtcta

SEQ ID NO: 67413 - DNA, 201 bp, Homo sapiens
ataactaatagttgaagaattgttttctcattttttgaacatctctctaaacctcaaaatcaaaaggcagctcacagggaagattgtctatttaaattgtygcagaattattaatttcatgtagacagcctcaagaggacagaaataggtttccacccccaccaccatgtgattcatattagcatgcacccattaatacag

SEQ ID NO: 67414 - DNA, 201 bp, Homo sapiens
gttttctcattttttgaacatctctctaaacctcaaaatcaaaaggcagctcacagggaagattgtctatttaaattgtcgcagaattattaatttcatgyagacagcctcaagaggacagaaataggtttccacccccaccaccatgtgattcatattagcatgcacccattaatacagacaataataatatagacaacg

SEQ ID NO: 67415 - DNA, 201 bp, Homo sapiens
ttcatatttataatgcaatatattaactactatatagtggcatgaacaaaatatgaaaaagcatagtaaacagataaaatagaaagtgagaccagactaayatggtgatggtagtctaagacagtatttcagcagaagactacaatctagctagcgacaatctgagaaccaaggcgatcaacagtgaaaactgtcaaaaga

SEQ ID NO: 67416 - DNA, 201 bp, Homo sapiens
ttttttgaacatctctctaaacctcaaaatcaaaaggcagctcacagggaagattgtctatttaaattgtcgcagaattattaatttcatgtagacagccycaagaggacagaaataggtttccacccccaccaccatgtgattcatattagcatgcacccattaatacagacaataataatatagacaacgggcaagtat

SEQ ID NO: 67417 - DNA, 201 bp, Homo sapiens
ggtagtctaagacagtatttcagcagaagactacaatctagctagcgacaatctgagaaccaaggcgatcaacagtgaaaactgtcaaaagacaacgaatyatgacctggacttcagtctttacaacaggatacctgacaaatttcatttcatgtagtttagaaacctgttagaactaagcattcttttgtggtctctcag

SEQ ID NO: 67418 - DNA, 201 bp, Homo sapiens
tatgcactggggataaaatatggctcgcctttaagaaatcagagattgacacagaaaataaatgtaaaaaaatcacagctagctctaaaatatactaagtrctgtaatatgcatctatgtgacctcagataggagagtaaccaattctccttgggtgatgtgaggacgcactcatgttttgaatcctaagtaagttggaaa

SEQ ID NO: 67419 - DNA, 201 bp, Homo sapiens
aatatgattacccaactccctgctttagtaataactacatttgcataagaacaggattaatggactgttccctcaaatatgggtcatagataagaagatcrtttgtaccaaatgtttatggcaaggagtttccatggcacaacaaactgcatgtgcttatgtatagagatggaaattgatgtagcatttccaaaaatgatg

SEQ ID NO: 67420 - DNA, 201 bp, Homo sapiens
ttggaaacctaagtaggaaacaccttgctgaaactttataatgaataaaaacatccagcatgcaaaaatacgctttcttattctcaggatccagaaggcartcgaatacaacagtgggtgaatgaggagtctgtgggagggattctacaactctccttccagttaatctcagagcccatcctcggatggtatgaaatcacc

SEQ ID NO: 67421 - DNA, 201 bp, Homo sapiens
tcgaatacaacagtgggtgaatgaggagtctgtgggagggattctacaactctccttccagttaatctcagagcccatcctcggatggtatgaaatcaccrtggagatgctcaatgagaagaaaacatatcactccttctctgtggaagaatatggtaaataatagcaatgaaaatattacctatcaataaaaaaattata

SEQ ID NO: 67422 - DNA, 201 bp, Homo sapiens
tatctttgcaagccagtgtttctaattgctggacattatctggttcagtattccatttagataaatagattcaatgcatggctggcctatgagatttgggyattcataataaatttgactacataataaaaatatagtaatgatgcaactgggctcattatcaaatgagccaagatatagagcatatacctagtttcttct

SEQ ID NO: 67423 - DNA, 201 bp, Homo sapiens
tggctggcctatgagatttgggcattcataataaatttgactacataataaaaatatagtaatgatgcaactgggctcattatcaaatgagccaagatatrgagcatatacctagtttcttctgcccaaatcttacatcggtcttttctttcattttctgcaatttcattgctgatggtgcctttcttttcctttaagtca

SEQ ID NO: 67424 - DNA, 201 bp, Homo sapiens
tggtatgaaatcaccatggagatgctcaatgagaagaaaacatatcactccttctctgtggaagaatatggtaaataatagcaatgaaaatattacctatyaataaaaaaattataaaatctttccaattttgcaagggcaagattattaaataatgaattttcaagtgagtatctcttcctttcctctttccttgtcctc

SEQ ID NO: 67425 - DNA, 201 bp, Homo sapiens
atatcactccttctctgtggaagaatatggtaaataatagcaatgaaaatattacctatcaataaaaaaattataaaatctttccaattttgcaagggcargattattaaataatgaattttcaagtgagtatctcttcctttcctctttccttgtcctctgttactattttagggttctccatctactgtgatttttatc

SEQ ID NO: 67426 - DNA, 201 bp, Homo sapiens
attttctcctaaaatcttcataaaatttctattgtagtatctttattactattttaaagatgaagatattgagaaacactttcccaagttcaacacctgaraagtgatgaatttggaattcaaaatatgcatttttctatccaattccaaaatccagtcttaggcacttcaacgtcctcctcacactgtttattaatggca

SEQ ID NO: 67427 - DNA, 201 bp, Homo sapiens
agaaacactttcccaagttcaacacctgagaagtgatgaatttggaattcaaaatatgcatttttctatccaattccaaaatccagtcttaggcacttcarcgtcctcctcacactgtttattaatggcaaacataagcaaaggttgatggtttgtaaaggagaaacaattgttttgtatgaatgtatttatgttaatatg

SEQ ID NO: 67428 - DNA, 201 bp, Homo sapiens
acaaacataggattttgacagccacaatgaattctttcattcttcctactctgcacctgtctgtggccttttcctctaccatgttctgtcacatccacatmattatctcgtgtcacagagccttccctgtgacttctgtgatgtatggctatgggcatggaatggatgtacttaacattatggcttttttattctttcttc

SEQ ID NO: 67429 - DNA, 201 bp, Homo sapiens
atggaaaagcaagtacatgaattcatagatgttaacaagcagtgcatttgtaaagctaaaaagaaacattttacctggtgtcctttcagatcatcagtctytctgctcagtcaagcacaattcttttaatccctatcttcatccacttgtctctctaaaattgattgggcttctcctaggatcttcatgtttgtacaaaga

SEQ ID NO: 67430 - DNA, 201 bp, Homo sapiens
aggattttgacagccacaatgaattctttcattcttcctactctgcacctgtctgtggccttttcctctaccatgttctgtcacatccacatcattatctygtgtcacagagccttccctgtgacttctgtgatgtatggctatgggcatggaatggatgtacttaacattatggcttttttattctttcttcctatttat

SEQ ID NO: 67431 - DNA, 201 bp, Homo sapiens
ttgactgctatttttatctagatagatagaccaatagatagatagatagatagatagatagatagataggatagataggatagataggggtggttttgttktttttttttttttttttttttttttagacagagtctcactcttttgcccaggctggaagtgtggtgacacgatctcagctcactgcaacctctgcctccc

SEQ ID NO: 67432 - DNA, 201 bp, Homo sapiens
tagagatggggggtctccctatattgctagggctggcctcaaacacctaggctcaagcagtcctcccacttcagcctcccaaagtgctacaattttaggcrtgtgccacagcacttggcctactgcagtagagatatagatacgaatacttttcttaagggtactgtacagttaggctgccctggaaccattatgtctctt

SEQ ID NO: 67433 - DNA, 201 bp, Homo sapiens
ggtggctcacgcctgtgatcccaacactttgggaggcggaggcgggcagatcacctgaggtcaggagtttgagaccagcctggccaacacggtgaaacccygtctctactaaaaatacaaaaattagccgggtgtggtggcatgcacctgtaatccccgctacctaggaggctgaggcaggagaatcactggagcctcgga

SEQ ID NO: 67434 - DNA, 201 bp, Homo sapiens
gtcaagtattgggttataagcagtagagataagagaacaggaatttggaaggaaagaacaccacgagctacattcattgggaatgcttggtggaaaaggtrgttctcaaggcaagttaaggaagaattttcagcaagacctgcaaagtcataaaaatgagtacgaatgtgacagataaggagacactggctgctcagaatt

SEQ ID NO: 67435 - DNA, 201 bp, Homo sapiens
ttttaggcatgtgccacagcacttggcctactgcagtagagatatagatacgaatacttttcttaagggtactgtacagttaggctgccctggaaccattmtgtctctttgagtttccttctctactctgaactttaagtgtctattttcttattttctagttcatagaagacatttcactatcacaactgtgtatttact

SEQ ID NO: 67436 - DNA, 201 bp, Homo sapiens
tttctaatcatataaatctcagtattcttggacatcaaggaagtcttatatttttaagcaaccctgtctgctaccatcttcccaacaaccccaccaccatstgttttgatgcctacacagaagatataagccagtggatcctacatttttttcaagtatttgctgaaatacaaagatttatcaaaattgctaagaagcagg

SEQ ID NO: 67437 - DNA, 201 bp, Homo sapiens
ggatcttcatgtttgtacaaagaaagcccaagctaaattttcaaggtcaaggaaaaaacatacgcttttccctgcctagataaaaccttcagacagaccaraataatggactagcattgctactgtccagatgttcatgtcctcccaaaatttgtatgttggaacctaaaatccaatgtgatagtattaagaggtatgata

SEQ ID NO: 67438 - DNA, 201 bp, Homo sapiens
aaggtcaaggaaaaaacatacgcttttccctgcctagataaaaccttcagacagaccagaataatggactagcattgctactgtccagatgttcatgtccycccaaaatttgtatgttggaacctaaaatccaatgtgatagtattaagaggtatgatagttgatacagtttggctgtgtccccacccaaatctcatcttg

SEQ ID NO: 67439 - DNA, 201 bp, Homo sapiens
aaattaaaacattagctgggcatggtggctcacacctatggtcttagctcctcgggaggctaaggtgagaggatcacctaagcctggggaggtcgaggctrcagtgagctatgatcataccactacattccagcctgggtgacagagcaagactgtctcaaaaaagaaaaaggaagaagaaggaggaggaaggaggaagaa

SEQ ID NO: 67440 - DNA, 201 bp, Homo sapiens
gagggctaataaacatcatatatacatgatgtttattacatatatattatatatattaggtatgtaatatatatgtattacatatatacacacacacacayatatatatatatatgtacacacacatatatatacaaagtctggctctatcacccaggctggagtgcagaggcacaatcttggctcactgcaacctctgcc

SEQ ID NO: 67441 - DNA, 201 bp, Homo sapiens
ctactaaaaatacaaaaattagccgggtgtggtggcatgcacctgtaatccccgctacctaggaggctgaggcaggagaatcactggagcctcggaggcaraggctgcagtgaactgagatcgcgccactgcactgcagcctggatgacagagcaagagtctgtctcaaaaaaaaaaaaaagaattagatcacagccccaa

SEQ ID NO: 67442 - DNA, 201 bp, Homo sapiens
acccgggaggcagaggttgcagtgagctgagaacgcgccactacactccagcctgggagacacagcgagactctgtctcaaaaaacaaaaacaaaaaacamcaacaacaaaaaaacaagtctctgctgactgcttgaactgaagacatctagtctcaggaactgtgaagcctccatcttccactatggccacagggaagga

SEQ ID NO: 67443 - DNA, 201 bp, Homo sapiens
ggaattctatgcagccataaaaaatcaaaatcatgtcctttgcagcaacatagatgcagctggaggccattattctaagcaaagaaatgcaggaaaagaawaacaaataccgtatgttctcacttacaaatgagagctacacatcaggtacttatggacataaagatggcaatactaggcactagggatgcctagaggtga

SEQ ID NO: 67444 - DNA, 201 bp, Homo sapiens
gaattctatgcagccataaaaaatcaaaatcatgtcctttgcagcaacatagatgcagctggaggccattattctaagcaaagaaatgcaggaaaagaaaracaaataccgtatgttctcacttacaaatgagagctacacatcaggtacttatggacataaagatggcaatactaggcactagggatgcctagaggtgag

SEQ ID NO: 67445 - DNA, 201 bp, Homo sapiens
catgtaccctctgaatataaagtaaaagttgggggaaaaaagagcagttttgctactgaagcttctggaatgtaactgaacaaccttttctcagatccagstattggataagaaatcaaatccagccatacgtggctgtgtacttctttgactatattattatcatattaagtagacttgatttcttaaaaagaaaataaa

SEQ ID NO: 67446 - DNA, 201 bp, Homo sapiens
gccctgcaaccacagattccactcaggtattgctcatatgcctcagtgtactctgactcagtggctttcagtccctgctcctcttccttctgctgtccctrttatcaccactggcatttctgttcctttccttctatgtctctccaactcccagagggaggatttgaccaactgtgtttggtcatcacccaatatcaaatc

SEQ ID NO: 67447 - DNA, 201 bp, Homo sapiens
tgggaacatgctccactgtttccagctttgtatagaaatttctaatcatataaatctcagtattcttggacatcaaggaagtcttatatttttaagcaacyctgtctgctaccatcttcccaacaaccccaccaccatctgttttgatgcctacacagaagatataagccagtggatcctacatttttttcaagtatttgc

SEQ ID NO: 67448 - DNA, 201 bp, Homo sapiens
tttttattgcactcagcatttttaattgttgctagcaggaaggttagtcagatgtcttagaccacaggaccactgtattgccagaatctaaagtcaaaaakccgctttaaaacataaagctaattatgtcactctcctgctttgaaactttcaatgcttttctcatgatatacagtgtaaatctgagctcctaagtgctct

SEQ ID NO: 67449 - DNA, 201 bp, Homo sapiens
caaatttacagaaacagagtgagtccatgtaagaaacctgaccttatacacagggacgatgcactgaaacctgtttcacagcaaagggaactgaaagtttytaaagcagtcaccacagcagccacgtggcttagaacacaaaacagacagccccctaaattatgaagtcatacacacagctgctaaataacagcactgagt

SEQ ID NO: 67450 - DNA, 201 bp, Homo sapiens
aagcagtgcatttgtaaagctaaaaagaaacattttacctggtgtcctttcagatcatcagtctctctgctcagtcaagcacaattcttttaatccctatyttcatccacttgtctctctaaaattgattgggcttctcctaggatcttcatgtttgtacaaagaaagcccaagctaaattttcaaggtcaaggaaaaaac

SEQ ID NO: 67451 - DNA, 201 bp, Homo sapiens
tatcaaatcaacataatgtacacttataagctagggatgcctgagaacataaccttcgatgtatctatttagtgcttgcaataaacagtgtgccatttatygtacttgggttggcacgtgcatgtctccaaattaataagaatgaaaaatgtaagtgatttagccaaagctgtaccataatccagtgatcatattgcatgc

SEQ ID NO: 67452 - DNA, 201 bp, Homo sapiens
acagtgtgccatttattgtacttgggttggcacgtgcatgtctccaaattaataagaatgaaaaatgtaagtgatttagccaaagctgtaccataatccartgatcatattgcatgcaagtaattaacaagttgcacctggtgagtaggaaggcaggcagccagaggctccagagccatcagaagggctgtcagggcacaa

SEQ ID NO: 67453 - DNA, 201 bp, Homo sapiens
agtcccagctacttgggaggctaaggcacgaggaatcgctcgaacccaggaagaggaggttgcagtgagccgagattgcaccactgcgctccagcctggcracagagcgagactccgtctcaaacaaacaaataaacaaaaaaaccctttgtgcccaccgtatgctagcgtaaaagtaatctgaatttgaaagtcaatcag

SEQ ID NO: 67454 - DNA, 201 bp, Homo sapiens
cctgtgcttctatgtgggaacatgctccactgtttccagctttgtatagaaatttctaatcatataaatctcagtattcttggacatcaaggaagtcttayatttttaagcaaccctgtctgctaccatcttcccaacaaccccaccaccatctgttttgatgcctacacagaagatataagccagtggatcctacatttt

SEQ ID NO: 67455 - DNA, 201 bp, Homo sapiens
gcatcaccatgccaaactaatttttgtatttttagtagaaacaaggtttcactatgttggccaggctgatctcgaactcctggtatcaagtgatccacccrcctcggcctcccaaaatgctaagattacaggtgtgagccaccatacccggccagcaacttttttttttttaagaatactatctatggtgactatttctag

SEQ ID NO: 67456 - DNA, 201 bp, Homo sapiens
atggaaaaaaaatccacctttgccagagcaaaggaagccagtgaaagaagtaattcattgggagtataattataagcatttagcattgttttgaacatgasaaaaaggcaagctttcatctaacagattttcataatctcaagaaataattcatctgccatttattttcagggaaatgtggtgcttcttggaagaagccca

SEQ ID NO: 67457 - DNA, 201 bp, Homo sapiens
atggactgacccaaggcccctgtgtcaggttgtgcaggtctgcactgcataactttaagggtaccatttccatccctactccccaaacttgtgccacacarcagccctggaagttacccgtctatagcatggaaaagcaagtacatgaattcatagatgttaacaagcagtgcatttgtaaagctaaaaagaaacatttta

SEQ ID NO: 67458 - DNA, 201 bp, Homo sapiens
actctgaaaactgaaacacgccaacaagttttctgttaccagtattttttttttaactctgtgcccaggccaggcgcggtggctcacgccggtaatctcakcgctttgggaggccgaggcgggcggatcgcgaggtcaggggtttgagcatcctggccaacatggtgaaaccccgtctttactaaaaatacaaaaatcagc

SEQ ID NO: 67459 - DNA, 201 bp, Homo sapiens
agatctatatttagtatgtctttaggagcatcatggttccttattcagaggatgagattgtatggaaatggcctatcccatgcagttcagcacaaggagayccagtgcagtacaggaacaatgtatgaaatgcttaaaaatgactattcattgcacattagagaatgcctatgtcacatttttacaattacagaactcttt

SEQ ID NO: 67460 - DNA, 201 bp, Homo sapiens
tctgcactgcataactttaagggtaccatttccatccctactccccaaacttgtgccacacagcagccctggaagttacccgtctatagcatggaaaagcragtacatgaattcatagatgttaacaagcagtgcatttgtaaagctaaaaagaaacattttacctggtgtcctttcagatcatcagtctctctgctcagt

SEQ ID NO: 67461 - DNA, 201 bp, Homo sapiens
gctaaaaagaaacattttacctggtgtcctttcagatcatcagtctctctgctcagtcaagcacaattcttttaatccctatcttcatccacttgtctctmtaaaattgattgggcttctcctaggatcttcatgtttgtacaaagaaagcccaagctaaattttcaaggtcaaggaaaaaacatacgcttttccctgcct

SEQ ID NO: 67462 - DNA, 201 bp, Homo sapiens
agaggtatgatagttgatacagtttggctgtgtccccacccaaatctcatcttgaattgtagctcccataattcccatgtgttgtaggagggacccggtgraaggtaattgaatcatggggacaggtctttcccatgccattctcatgatagtgagtaagtctcatgagatctgatggttttataaaggggagttctcctg

SEQ ID NO: 67463 - DNA, 201 bp, Homo sapiens
ctatcattcatagtggaccccctctatcatcacagagaaaatcattgatgaccagcactgactccaatattacccaagatctatatttagtatgtctttakgagcatcatggttccttattcagaggatgagattgtatggaaatggcctatcccatgcagttcagcacaaggagacccagtgcagtacaggaacaatgta

SEQ ID NO: 67464 - DNA, 201 bp, Homo sapiens
agtgcaggatagtcataaatgcctgtaaatactgaagaggcacgacctcataagcagccacaaaaatgcaaactagagccacaaggtatgaagtgatgacraggatgtggagccaaaggtgcctggtgcctgttccttgtatatttatatttttacaattttaatttctgcagggtctttttctttttttttaaacagagt

SEQ ID NO: 67465 - DNA, 201 bp, Homo sapiens
gagctgcaggcatgaccaacctgcgttcactctcattctaatcttaagatttcatcctttctacacacactcggtgtgaacagtctgcaaaccgtggtgasagcccattggtggggtatgaagtctgagaagaggtatacaatttttcccaccacatccagttccccccacaatagttgtagggtcctctggagcccaaat

SEQ ID NO: 67466 - DNA, 201 bp, Homo sapiens
tatgtctttaggagcatcatggttccttattcagaggatgagattgtatggaaatggcctatcccatgcagttcagcacaaggagacccagtgcagtacasgaacaatgtatgaaatgcttaaaaatgactattcattgcacattagagaatgcctatgtcacatttttacaattacagaactcttttttttttttttgga

SEQ ID NO: 67467 - DNA, 201 bp, Homo sapiens
acctcagcctcctaaactgctgggattacaggcatgagccactgtccccggcaacattacagtctatcatttttataaaaatagcagcaacctgtaaaagytcccagtggaaagctgcatggtcatacagggagggttcaccaggaaagttcctacctgcctgtctgccaagtgaccttaaaagggagcataacttggtga

SEQ ID NO: 67468 - DNA, 201 bp, Homo sapiens
tatttttagtagagacagggtttcaccatgttgcctaggctggtctgaaactcctgacctcaagtgtttctcccacctcagcctcctaaactgctgggatwacaggcatgagccactgtccccggcaacattacagtctatcatttttataaaaatagcagcaacctgtaaaagttcccagtggaaagctgcatggtcata

SEQ ID NO: 67469 - DNA, 201 bp, Homo sapiens
atttaactttaaaatagcataaaaattcttcttagtaaatcgtaactaacaagaagaaggaaatataatggtcgataattaatcaaatatccaaaatgacrgctaagggaaaaaaatccaccaccgccacctgaacgacctttcagtgaaatgagcgttgtggattttagaattcagaattctctgttcttgttcctgtga

SEQ ID NO: 67470 - DNA, 201 bp, Homo sapiens
ctaaaccaaaacagtgttttagctccaggtattaatggccacttctggagccataagcaaagctgataatatagctcctaaataaagaactggaatatggytggcaaagaatcaccttcttaatttcttaagaatgttcaactctggcacaaagtggacaaggtgagtatgggtgaatatccttctagagagatgagacta

SEQ ID NO: 67471 - DNA, 201 bp, Homo sapiens
tattattcaaccatcagaaaagaaccaactccttcctagataagagacaacagcacttgcccctacccatactaatgccacggctatttgtccatcaaagkaaatgaatggctttgtatttgaatagaaaagaggggcactctgagctctgaggtgacagataatgcactgatcagtcactctccagtgggggtatcagaa

SEQ ID NO: 67472 - DNA, 201 bp, Homo sapiens
atatggttggcaaagaatcaccttcttaatttcttaagaatgttcaactctggcacaaagtggacaaggtgagtatgggtgaatatccttctagagagatragactagaagactgaggatctacagaaggggatgcccagttattctctctccccctactctcgaaactcactcattaattcatgtatttatcaaaatggc

SEQ ID NO: 67473 - DNA, 201 bp, Homo sapiens
tagaacacaatatcccaggagcaagaaaccaacgttatcatcacattacaaacagtgtttctgttcatacaaagatcatatcagctttttacttggactarcacacttgcctccctggccctcggggaccatagcatgatctagcagtgccagtgagttaacaaaggcttaccaagttccatggtagggcacagggagagc

SEQ ID NO: 67474 - DNA, 201 bp, Homo sapiens
aaactataaaagaaaattaagtaaattattacaacaagttgtggacaatggttgtctgggacagagaaagctacgatggagaagggcacaaatggagattstgcggtgcttatgatattctatttccttcatctgggtggtggctacatgaatagcaggtttatattatttgttaaactgtatattcatgtttgtgcactt

SEQ ID NO: 67475 - DNA, 201 bp, Homo sapiens
gtctgtaagagatcagggacattgggagcagcatctatccaaccacgcagaaggacagtgggtgcccaaaccaaagggccaattaggcaacctggtcacartaggagttagactgaggagctgccactccctaattcacaggagcccagaaggctcaaacagatttaaaacacacaaaggagggcatgggagcagcagatc

SEQ ID NO: 67476 - DNA, 201 bp, Homo sapiens
tctgggacagagaaagctacgatggagaagggcacaaatggagattgtgcggtgcttatgatattctatttccttcatctgggtggtggctacatgaatarcaggtttatattatttgttaaactgtatattcatgtttgtgcactttttctgtatatatggtatatttcccacaggatgtttttcagaaaggttatatag

SEQ ID NO: 67477 - DNA, 201 bp, Homo sapiens
agttggttagccttgattccaacccctgatttcaagcattggagggctaataaacatcatatatacatgatgtttattacatatatattatatatattagrtatgtaatatatatgtattacatatatacacacacacacacatatatatatatatgtacacacacatatatatacaaagtctggctctatcacccaggct

SEQ ID NO: 67478 - DNA, 201 bp, Homo sapiens
gagcagcatctatccaaccacgcagaaggacagtgggtgcccaaaccaaagggccaattaggcaacctggtcacaataggagttagactgaggagctgccwctccctaattcacaggagcccagaaggctcaaacagatttaaaacacacaaaggagggcatgggagcagcagatcctcccagaccccttgttagtcacag

SEQ ID NO: 67479 - DNA, 201 bp, Homo sapiens
tatattatttgttaaactgtatattcatgtttgtgcactttttctgtatatatggtatatttcccacaggatgtttttcagaaaggttatatagacatatragactagatggtctggtaaaagaatgacaggtgatagacaaaaggcaaacaaaaaatataatcaggaggtaataagtgctatgaagaaaagaaaagcagg

SEQ ID NO: 67480 - DNA, 201 bp, Homo sapiens
taaaagaatgacaggtgatagacaaaaggcaaacaaaaaatataatcaggaggtaataagtgctatgaagaaaagaaaagcaggataggggaataggttgrgaagagagaactatttaacggcttgtagcaccaggatctccatagttaagcctcatggagtgccactgtgaacacagcaaaggcaatgcaaattgaatgc

SEQ ID NO: 67481 - DNA, 201 bp, Homo sapiens
cggcctcccaaaatgctaagattacaggtgtgagccaccatacccggccagcaacttttttttttttaagaatactatctatggtgactatttctagcccrccatgatagcgagtgtcttcaaagagagctgcaggcatgaccaacctgcgttcactctcattctaatcttaagatttcatcctttctacacacactcggt

SEQ ID NO: 67482 - DNA, 201 bp, Homo sapiens
gggagaggccccctcaaaacaggaactcctgccggctgacttaattacagcacagcaagggaatccactacaaaggcaggagccactgaacagagagctgytgagatccgtcctcggtacacggacagatggttctgctgcttctcggctggtataagaccttatagaagactctgaaaactgaaacacgccaacaagttt

SEQ ID NO: 67483 - DNA, 201 bp, Homo sapiens
tcatctcctctgaaaggccatgcctggccctcatttctcaaatagccaccccagccagcacccccgccagtcttgttattcctccaccttgctttatttastttttagcacatatcaccctgtaaaattatgcatttacttgcttaagcttttgttgcctttctcccccacaagtgtgtcaacccgctgagggcaggaact

SEQ ID NO: 67484 - DNA, 201 bp, Homo sapiens
cctggtgcctgttccttgtatatttatatttttacaattttaatttctgcagggtctttttctttttttttaaacagagtctcactctgtcgcccaggctrgagtgcagtggcgtgatctgatctcggctcactgcaaccttcacctcccgggttcaagcaattctcctgcctcagcctcccaagtagctgggattacagg

SEQ ID NO: 67485 - DNA, 201 bp, Homo sapiens
ccatgccattctcatgatagtgagtaagtctcatgagatctgatggttttataaaggggagttctcctgcacacaccctcttgcctgctgccatgtaagaygtacctttggtcttccttcaccttctgccatgactgtgaggcctccgcagccacctggaactgcaagtccattaaataaattacccagtcgtgggtatgt

SEQ ID NO: 67486 - DNA, 201 bp, Homo sapiens
tgagataactcagatgagatggaatggtggggactctggtgaattagagattcacgctctttctaaaagaaaggtgaaggttcatgcctgtaattccagcmctttgggatgtaaaggcagaagatcgcttgaggcaaggaatttgagaccaggccagccaatatagtgaagtgttgtctctacaataaatttaaaaattag

SEQ ID NO: 67487 - DNA, 201 bp, Homo sapiens
tcacgctctttctaaaagaaaggtgaaggttcatgcctgtaattccagcactttgggatgtaaaggcagaagatcgcttgaggcaaggaatttgagaccasgccagccaatatagtgaagtgttgtctctacaataaatttaaaaattagccaggtgtggtgatgcacacctgtagtcccaggtactcaggaggctgagat

SEQ ID NO: 67488 - DNA, 201 bp, Homo sapiens
ctcccaaagtgctacaattttaggcatgtgccacagcacttggcctactgcagtagagatatagatacgaatacttttcttaagggtactgtacagttagsctgccctggaaccattatgtctctttgagtttccttctctactctgaactttaagtgtctattttcttattttctagttcatagaagacatttcactatc

SEQ ID NO: 67489 - DNA, 201 bp, Homo sapiens
gacattgttatgcaagtagatagaatattaacctgcctggattaatgaaagcaattactaagtgctgttactataagtggaatagtttcactgtatcacaygtcctggtgattcttcatttagcccagatgatgccaggggctatttgacaaaatgtttcgtatatctaagaagacatattttgctggtttaaaccataat

SEQ ID NO: 67490 - DNA, 201 bp, Homo sapiens
gtttcaccatgttgcctaggctggtctgaaactcctgacctcaagtgtttctcccacctcagcctcctaaactgctgggattacaggcatgagccactgtscccggcaacattacagtctatcatttttataaaaatagcagcaacctgtaaaagttcccagtggaaagctgcatggtcatacagggagggttcaccagga

SEQ ID NO: 67491 - DNA, 201 bp, Homo sapiens
ctagggataatgcaaattataagtaccataggataccattatacacccatcagttgagccaaatgttaaaatctgacaatatccaatgatggtgagaatasagaattctcatacactgctggaaggtaaataaattggtatgatcgctttggaaaatacaggcaggttgaagattggcaattctacaccactgtgatcacg

SEQ ID NO: 67492 - DNA, 201 bp, Homo sapiens
ggagccttgaagatgtttttaaaaaattaagtgagcagttgaggtaaataatgaatgattttacaatcacagatcatttaactttaaaatagcataaaaattcttcttagtaaatcgtaactaacaagaagaaggaaatataatggtcgataattaatcaaatatccaaaatgacggctaagggaaaaaaatccaccaccg

SEQ ID NO: 67493 - DNA, 201 bp, Homo sapiens
aaattataagtaccataggataccattatacacccatcagttgagccaaatgttaaaatctgacaatatccaatgatggtgagaatagagaattctcatamactgctggaaggtaaataaattggtatgatcgctttggaaaatacaggcaggttgaagattggcaattctacaccactgtgatcacgctcatagaaattc

SEQ ID NO: 67494 - DNA, 201 bp, Homo sapiens
gagccttgaagatgtttttaaaaaattaagtgagcagttgaggtaaataatgaatgattttacaatcacagatcatttaactttaaaatagcataaaaattcttcttagtaaatcgtaactaacaagaagaaggaaatataatggtcgataattaatcaaatatccaaaatgacggctaagggaaaaaaatccaccaccgc

SEQ ID NO: 67495 - DNA, 201 bp, Homo sapiens
agccttgaagatgtttttaaaaaattaagtgagcagttgaggtaaataatgaatgattttacaatcacagatcatttaactttaaaatagcataaaaattcttcttagtaaatcgtaactaacaagaagaaggaaatataatggtcgataattaatcaaatatccaaaatgacggctaagggaaaaaaatccaccaccgcc

SEQ ID NO: 67496 - DNA, 201 bp, Homo sapiens
gggctaataaacatcatatatacatgatgtttattacatatatattatatatattaggtatgtaatatatatgtattacatatatacacacacacacacayatatatatatatgtacacacacatatatatacaaagtctggctctatcacccaggctggagtgcagaggcacaatcttggctcactgcaacctctgcctc

SEQ ID NO: 67497 - DNA, 201 bp, Homo sapiens
aacaataaagcatttttaatttgaaaaattagttgactgctatttttatctagatagatagaccaatagatagatagatagatagatagatagatagataggatagataggatagataggggtggttttgttttttttttttttttttttttttttttagacagagtctcactcttttgcccaggctggaagtgtggtgac

SEQ ID NO: 67498 - DNA, 201 bp, Homo sapiens
ggggcttacgatcctcattttctgggtttgggtgatgttagaggaaagtgccccagcccagcaccattcctttttgcttctggtttggagctctagaccasagccttagttctggtcagttgttaagtaattatttaacagtgtgacgttcagacctgcatgacatctatacagtgtccagtaaagaaagagaaagccatg

SEQ ID NO: 67499 - DNA, 201 bp, Homo sapiens
cacgatctcagctcactgcaacctctgcctcccaggttcaagcgattctcctgtctcagcctccccagtagctcagagtacaggcgcctgccaccacaccyggctaatttttgtatttttaatagagacggggtttcaccatgttggccaggctggtctcgaactcctgacctctagtgacccgcccaccttggcctccta

SEQ ID NO: 67500 - DNA, 201 bp, Homo sapiens
tgagctcatgatatcaccatccacctgcttccccaagcccaagctttggaagccacagtgaatgtgaggcactattggctaacatgtaacagtgaccatgygacagtaattgttaacagtgtgcaagagaaaactgtaaggctggctgctaaatatgcctgataaataactgtcaacttaacgctggtagtatgattagga

SEQ ID NO: 67501 - DNA, 201 bp, Homo sapiens
tatatatgatctaatacaaaaataaacatcagtcctatactgttagatgaagaaataggttccaagatttaagaggcagaactgagaatgcaagtcctgcrctatcatcctccacacgcctctcctttgtccctctccaccttccttccccctttattttcctttcctagaagggaaggagggtgtcagcatctcaatcaa

SEQ ID NO: 67502 - DNA, 201 bp, Homo sapiens
atctgtggtaagtgctattcaaaatgggtgtccaggccaggcgcggtggctcacgcctgtaatcccagcactttgggaggctgaggcggatggatcatttraggttaggggtttgagaccagcctggccaacatggtgaaaccccacctctactaaaaatagaaaaattagctgggcgtagtggcgggcgcctgtactccg

SEQ ID NO: 67503 - DNA, 201 bp, Homo sapiens
attttcctttcctagaagggaaggagggtgtcagcatctcaatcaaaagtcaaaactcacatgtcaacaggtaagtgacagatgatgtaaatgagggaagmacagagatagtgagataactcagatgagatggaatggtggggactctggtgaattagagattcacgctctttctaaaagaaaggtgaaggttcatgcctg

SEQ ID NO: 67504 - DNA, 201 bp, Homo sapiens
agtcgccgcatttcctctggtgtataacatgttgttgatgcagttattgtcctttgttttttttttagctctgtttccttaaatgccaaaactacacacacgaagtatgtaatacgaacactgtgacaatgaggagatgcaagtaacattttattcacctgaagaaactaaaccccaacattttgctttttgtctacagac

SEQ ID NO: 67505 - DNA, 201 bp, Homo sapiens
gtcgccgcatttcctctggtgtataacatgttgttgatgcagttattgtcctttgttttttttttagctctgtttccttaaatgccaaaactacacacacgaagtatgtaatacgaacactgtgacaatgaggagatgcaagtaacattttattcacctgaagaaactaaaccccaacattttgctttttgtctacagaca

SEQ ID NO: 67506 - DNA, 201 bp, Homo sapiens
aagaatgtacaataatgccactgaagcaatttagaacttacaatgcccatagcatagaatctattatatatagatatctaattatatctatctaaacacayacatatacagatgctcctcaactgatgatgagattatgtcctagtaaacccatcatagtttgaaaaatatcataagtcaaaaatacatttaatacgccta

SEQ ID NO: 67507 - DNA, 201 bp, Homo sapiens
tgcagtgagccgaaatcacaccactgcaatccagtctgggcaacagagcgagacactgtctcaaacaaaacaaaaacaaaaacaacaacaacaaaaaaacytaacttaaaaatactaaatattcagtgaaaactagagtcatgctaaaccaaaacagtgttttagctccaggtattaatggccacttctggagccataagc

SEQ ID NO: 67508 - DNA, 201 bp, Homo sapiens
ccaaagggccaattaggcaacctggtcacaataggagttagactgaggagctgccactccctaattcacaggagcccagaaggctcaaacagatttaaaayacacaaaggagggcatgggagcagcagatcctcccagaccccttgttagtcacaggtactcctggtctggctctcaaaagcaaggccttcccaactttgt

SEQ ID NO: 67509 - DNA, 201 bp, Homo sapiens
  misc_feature (1)...(201): n = A,T,C or G, or insertion/deletion polymorphism (see Tables 1-2)
ctggttaccttactctgacagtgatgcagccagaggcactaaagggttagcccaagggccccagccctgcatttggcccatgaaggggcttacgatcctcnttttctgggtttgggtgatgttagaggaaagtgccccagcccagcaccattcctttttgcttctggtttggagctctagaccagagccttagttctggtc

SEQ ID NO: 67510 - DNA, 201 bp, Homo sapiens
tcagatcacttcttaccctcaagtagattctctctcagtctaagccaccatcatctcttacctgaactactgcaatagcctcctaacttggctcactcttycactgtctgcaaggaataaccagagtgatcttttaaaaacatgtatgaaatcacatcactcaggcggcttaaaataaaatccagacttctcaccagggct

SEQ ID NO: 67511 - DNA, 201 bp, Homo sapiens
aaagggccaattaggcaacctggtcacaataggagttagactgaggagctgccactccctaattcacaggagcccagaaggctcaaacagatttaaaacayacaaaggagggcatgggagcagcagatcctcccagaccccttgttagtcacaggtactcctggtctggctctcaaaagcaaggccttcccaactttgtta

SEQ ID NO: 67512 - DNA, 201 bp, Homo sapiens
gtcacaggtactcctggtctggctctcaaaagcaaggccttcccaactttgttacagtcagctatgctgaagccttggctggcagaaactgacaagccccrtaacacagctttccccatctggccccaaaccatctctccaggctcacctcccctctcaccccattccatctacctccctactgcaacaacacagacactg

SEQ ID NO: 67513 - DNA, 201 bp, Homo sapiens
gtgagaatagagaattctcatacactgctggaaggtaaataaattggtatgatcgctttggaaaatacaggcaggttgaagattggcaattctacaccacygtgatcacgctcatagaaattcgcaaacatgttcaccaggctatatgtacaacaggtgcagagcagcactattcataatagcccaaacaatgaaagcaag

SEQ ID NO: 67514 - DNA, 201 bp, Homo sapiens
gggtcaatgttttgccttaattcctgacttgcatctttttaactctgacactaatttttctcttggttcacctaagacatctataatgtaactttattgtkctacatttcagatcattttctggcaatgcttctttgacatagcatacaaattttgcaacatgaagcaatatacatttcttgacttcaaaaaaatatggtt

SEQ ID NO: 67515 - DNA, 201 bp, Homo sapiens
tggaaaatacaggcaggttgaagattggcaattctacaccactgtgatcacgctcatagaaattcgcaaacatgttcaccaggctatatgtacaacaggtrcagagcagcactattcataatagcccaaacaatgaaagcaagtcaaaacccatcaactaaaaaatggataaactgtggtacaatcatacaatgggatact

SEQ ID NO: 67516 - DNA, 201 bp, Homo sapiens
ggaaaaaaagtaaacttccttaatttacattcactgactactcagattgaacatctcttcccatttactgatttacttgcaaatcctctctgactagttgstctttgtccttttttcctattgcattatgttgttttcaataaactcatcgtacctatattttaggaataataattgtttgtaagtcatccacatcgcact

SEQ ID NO: 67517 - DNA, 201 bp, Homo sapiens
ggataaactgtggtacaatcatacaatgggatactataccataacaaaatgaaataactagcactgtgtacaacaacctggagaatctcacacacacacamaaaaaaatgttaaatgaaagaaaaagcattaaataatatatgcaatattattccattcatgtaaagttcaaaaagcagacaaaaactaaattatgtgtga

SEQ ID NO: 67518 - DNA, 201 bp, Homo sapiens
aacatctcttcccatttactgatttacttgcaaatcctctctgactagttggtctttgtccttttttcctattgcattatgttgttttcaataaactcatygtacctatattttaggaataataattgtttgtaagtcatccacatcgcactatttcttccaaactgttctttttcatttctaaaaccaaataagtcagtc

SEQ ID NO: 67519 - DNA, 201 bp, Homo sapiens
ataaactgtggtacaatcatacaatgggatactataccataacaaaatgaaataactagcactgtgtacaacaacctggagaatctcacacacacacaaamaaaaatgttaaatgaaagaaaaagcattaaataatatatgcaatattattccattcatgtaaagttcaaaaagcagacaaaaactaaattatgtgtgata

SEQ ID NO: 67520 - DNA, 201 bp, Homo sapiens
gtttccttaaatgccaaaactacacacacgaagtatgtaatacgaacactgtgacaatgaggagatgcaagtaacattttattcacctgaagaaactaaamcccaacattttgctttttgtctacagacacagttcctgtaaacacagaatcaaatacggtgcgcgtagaaaataaaaagatcctcccacactatggcact

SEQ ID NO: 67521 - DNA, 201 bp, Homo sapiens
gatctggcagcattagactgtcaacaattgaagaaaagaaaataagaaaagctgtctatattttgggtgcttcatgagagaataatcttaatgatgaaatwtttttaaggcttagaaaactaatgaagccctcaaatatggtgtgagatctctttataagaatgctgcaagagtcagatgtgaagcgaaggctgttgtaat

SEQ ID NO: 67522 - DNA, 201 bp, Homo sapiens
ttcaagtacaacaaaaaaatccgggtttcccatcacagaacctaagtcgccgcatttcctctggtgtataacatgttgttgatgcagttattgtcctttgttttttttttagctctgtttccttaaatgccaaaactacacacacgaagtatgtaatacgaacactgtgacaatgaggagatgcaagtaacattttattca

SEQ ID NO: 67523 - DNA, 201 bp, Homo sapiens
gaaagtgactgtctactggaagaatctgtgcaggctccatcacaggcagctgcagctctgtatgagggcctctgggggagctgggaacctgtgcttctatrtgggaacatgctccactgtttccagctttgtatagaaatttctaatcatataaatctcagtattcttggacatcaaggaagtcttatatttttaagcaac

SEQ ID NO: 67524 - DNA, 201 bp, Homo sapiens
tcccatcacagaacctaagtcgccgcatttcctctggtgtataacatgttgttgatgcagttattgtcctttgttttttttttagctctgtttccttaaatgccaaaactacacacacgaagtatgtaatacgaacactgtgacaatgaggagatgcaagtaacattttattcacctgaagaaactaaaccccaacatttt

SEQ ID NO: 67525 - DNA, 201 bp, Homo sapiens
cggtggctcacgccggtaatctcagcgctttgggaggccgaggcgggcggatcgcgaggtcaggggtttgagcatcctggccaacatggtgaaaccccgtytttactaaaaatacaaaaatcagctgggcgtggtggcgcttgtctgtagtcccagctacttgggaggctaaggcacgaggaatcgctcgaacccaggaag

SEQ ID NO: 67526 - DNA, 201 bp, Homo sapiens
cacgaggaatcgctcgaacccaggaagaggaggttgcagtgagccgagattgcaccactgcgctccagcctggcgacagagcgagactccgtctcaaacamacaaataaacaaaaaaaccctttgtgcccaccgtatgctagcgtaaaagtaatctgaatttgaaagtcaatcagcaagtatttactgagcgacgtgtaag

SEQ ID NO: 67527 - DNA, 201 bp, Homo sapiens
tggcctgaaatcctgtttatgtgattctgtttcttgaaaaaagcagctccctaaatcaaaatgtttatcaatcaccaagcctgactgtggccacgggataycagcttgcaatatctgctgtagaccaaaggtggccaggcttgtcggcattgctcccgacactatggtgtttcacttagaaagtttaacaaccacacagtc

SEQ ID NO: 67528 - DNA, 201 bp, Homo sapiens
acttcttaccctcaagtagattctctctcagtctaagccaccatcatctcttacctgaactactgcaatagcctcctaacttggctcactcttccactgtstgcaaggaataaccagagtgatcttttaaaaacatgtatgaaatcacatcactcaggcggcttaaaataaaatccagacttctcaccagggctcagagaa

SEQ ID NO: 67529 - DNA, 201 bp, Homo sapiens
cgatcttggctcactgcaacctctacctcccaggttcaagtgattcttgtgcctcaacctcccgagtagctaggattacaggtgtgcaccaccatacccgkctaatttttgcatttttagtagagatggggtttcaccatgttggtcaggctggtctcaaactcctgacctcaggtgatccacctgactcagcctcccaaa

SEQ ID NO: 67530 - DNA, 201 bp, Homo sapiens
atgggtgaatatccttctagagagatgagactagaagactgaggatctacagaaggggatgcccagttattctctctccccctactctcgaaactcactcattaattcatgtatttatcaaaatggcatgtcaataccctgagcagccactcaggacaggactcctgcattgctacaataccgatcccccagcctctcctc

SEQ ID NO: 67531 - DNA, 201 bp, Homo sapiens
ctatcatcctccacacgcctctcctttgtccctctccaccttccttccccctttattttcctttcctagaagggaaggagggtgtcagcatctcaatcaaragtcaaaactcacatgtcaacaggtaagtgacagatgatgtaaatgagggaagaacagagatagtgagataactcagatgagatggaatggtggggactc

SEQ ID NO: 67532 - DNA, 201 bp, Homo sapiens
cagaagatcgcttgaggcaaggaatttgagaccaggccagccaatatagtgaagtgttgtctctacaataaatttaaaaattagccaggtgtggtgatgcmcacctgtagtcccaggtactcaggaggctgagatgtaaggatcacttaaacccagcaggtctaggctgcagtgagctgtgtttgtctcactgcactccag

SEQ ID NO: 67533 - DNA, 201 bp, Homo sapiens
cctcaagtagattctctctcagtctaagccaccatcatctcttacctgaactactgcaatagcctcctaacttggctcactcttccactgtctgcaaggartaaccagagtgatcttttaaaaacatgtatgaaatcacatcactcaggcggcttaaaataaaatccagacttctcaccagggctcagagaacctgcttgc

SEQ ID NO: 67534 - DNA, 201 bp, Homo sapiens
ccacacagtcccacagtgcacagcacagttccgagccgcaaaggcttgcagtacccaaaatgccatttgccattttcacaaaaacccagttcattctcatytcaagatctttttttttttttttttgagacagagtctcgctctgtcgcctaggctgcagtgcagtggcacgatctcggttcactgcaacctccgcctccc

SEQ ID NO: 67535 - DNA, 201 bp, Homo sapiens
atttgagaccaggccagccaatatagtgaagtgttgtctctacaataaatttaaaaattagccaggtgtggtgatgcacacctgtagtcccaggtactcasgaggctgagatgtaaggatcacttaaacccagcaggtctaggctgcagtgagctgtgtttgtctcactgcactccagcctaggtgacagcgcaagagacc

SEQ ID NO: 67536 - DNA, 201 bp, Homo sapiens
tagattctctctcagtctaagccaccatcatctcttacctgaactactgcaatagcctcctaacttggctcactcttccactgtctgcaaggaataaccasagtgatcttttaaaaacatgtatgaaatcacatcactcaggcggcttaaaataaaatccagacttctcaccagggctcagagaacctgcttgctgactcc

SEQ ID NO: 67537 - DNA, 201 bp, Homo sapiens
tatagtgaagtgttgtctctacaataaatttaaaaattagccaggtgtggtgatgcacacctgtagtcccaggtactcaggaggctgagatgtaaggatcmcttaaacccagcaggtctaggctgcagtgagctgtgtttgtctcactgcactccagcctaggtgacagcgcaagagaccctgtctcaaaaaaaaaaaaaa

SEQ ID NO: 67538 - DNA, 201 bp, Homo sapiens
gttgtctctacaataaatttaaaaattagccaggtgtggtgatgcacacctgtagtcccaggtactcaggaggctgagatgtaaggatcacttaaacccascaggtctaggctgcagtgagctgtgtttgtctcactgcactccagcctaggtgacagcgcaagagaccctgtctcaaaaaaaaaaaaaaaaaaaaaaaaa

SEQ ID NO: 67539 - DNA, 201 bp, Homo sapiens
tattatgacaggaaaaaaactcaagtattttggcttgaaaatataaactataaacatataggaaaaattttggtttaaaactaagcacaaattacgctggttttttttaagaaaaggaacaattatatttttcataatactaaaaatgaaataatgtaaagtgataaaaagcaattaattcctacttaggtaatatttcat

SEQ ID NO: 67540 - DNA, 201 bp, Homo sapiens
gttcagcactagaggcaatatttcagatgcttaagtggaaatacgcatatgcttcctcaaaaatcacaaatagaactgttagattagaacttgtacctttytgaatactttatgaaaagcccttaaataatatttttttccaaagtgacttcttaagaattagctcaggccgggtgcggtggctcacgcctgtgatcccaa

SEQ ID NO: 67541 - DNA, 201 bp, Homo sapiens
ccatctctccaggctcacctcccctctcaccccattccatctacctccctactgcaacaacacagacactgacaagcagcactctctccagccttccctcytctacaggctgtttcatcctcctgaatgactttgcccctcttctctccccggaaaatccctacttattcttcaaagccccctcaaatgttgcctgatcag

SEQ ID NO: 67542 - DNA, 201 bp, Homo sapiens
tcccctctcaccccattccatctacctccctactgcaacaacacagacactgacaagcagcactctctccagccttccctcttctacaggctgtttcatcytcctgaatgactttgcccctcttctctccccggaaaatccctacttattcttcaaagccccctcaaatgttgcctgatcaggagattactctgattcaag

SEQ ID NO: 67543 - DNA, 201 bp, Homo sapiens
cccgctacctaggaggctgaggcaggagaatcactggagcctcggaggcagaggctgcagtgaactgagatcgcgccactgcactgcagcctggatgacasagcaagagtctgtctcaaaaaaaaaaaaaagaattagatcacagccccaataagatttctggtaacatctaattagacaattgagttcccttgctggagc

SEQ ID NO: 67544 - DNA, 201 bp, Homo sapiens
caccatcatctcttacctgaactactgcaatagcctcctaacttggctcactcttccactgtctgcaaggaataaccagagtgatcttttaaaaacatgtrtgaaatcacatcactcaggcggcttaaaataaaatccagacttctcaccagggctcagagaacctgcttgctgactccctctccactgcccctctcacat

SEQ ID NO: 67545 - DNA, 201 bp, Homo sapiens
cagtgtggcatttgcacaagaatagaccaacaaaccaatgtaacagaatagtccaaaaatagacccatgcatatataaaaacttgatttatcacaaaacasacattggaaattagtgcaggaaagatcaactgttcagtaacctgtggtattgagatcactggctaattttattggggggtggggtggaatcatgggaaaa

SEQ ID NO: 67546 - DNA, 201 bp, Homo sapiens
gtccaaaaatagacccatgcatatataaaaacttgatttatcacaaaacacacattggaaattagtgcaggaaagatcaactgttcagtaacctgtggtaytgagatcactggctaattttattggggggtggggtggaatcatgggaaaaaatttaaattagatttctacctcacaccaaacacaaaaatcaattccagg

SEQ ID NO: 67547 - DNA, 201 bp, Homo sapiens
gccaggtgtggtgatgcacacctgtagtcccaggtactcaggaggctgagatgtaaggatcacttaaacccagcaggtctaggctgcagtgagctgtgttygtctcactgcactccagcctaggtgacagcgcaagagaccctgtctcaaaaaaaaaaaaaaaaaaaaaaaaaaaaaagccacgcatggtggctcatgcct

SEQ ID NO: 67548 - DNA, 201 bp, Homo sapiens
aagagaccatttatgtatatagagaattagtacaggcatttatttttccagggactgagataagaggaaaataaccaagggaagaatttgttcagcactakaggcaatatttcagatgcttaagtggaaatacgcatatgcttcctcaaaaatcacaaatagaactgttagattagaacttgtacctttttgaatacttta

SEQ ID NO: 67549 - DNA, 201 bp, Homo sapiens
aacctgtggtattgagatcactggctaattttattggggggtggggtggaatcatgggaaaaaatttaaattagatttctacctcacaccaaacacaaaamtcaattccagggagaattaaagatttaaatataaaagtcaaaccagaagatattcagaagacaatataggtgcatgtttttatgacttcatggaaaggat

SEQ ID NO: 67550 - DNA, 201 bp, Homo sapiens
caaaccagaagatattcagaagacaatataggtgcatgtttttatgacttcatggaaaggatttcttaagaatagaaaaatacaacctagaaacacaaaasagtgataaatcaactaaattaaaattataaacttctcttcttcaaaggataccacagaaagagtaaaaagacaacccatggactaggaaaagatatttcc

SEQ ID NO: 67551 - DNA, 201 bp, Homo sapiens
ctctgacactaatttttctcttggttcacctaagacatctataatgtaactttattgttctacatttcagatcattttctggcaatgcttctttgacatakcatacaaattttgcaacatgaagcaatatacatttcttgacttcaaaaaaatatggtttccccataatgtatatgaaaacatatcaaaggtgggttacat

SEQ ID NO: 67552 - DNA, 201 bp, Homo sapiens
ctagcccgccatgatagcgagtgtcttcaaagagagctgcaggcatgaccaacctgcgttcactctcattctaatcttaagatttcatcctttctacacamactcggtgtgaacagtctgcaaaccgtggtgacagcccattggtggggtatgaagtctgagaagaggtatacaatttttcccaccacatccagttccccc

SEQ ID NO: 67553 - DNA, 201 bp, Homo sapiens
gtctcaaactcctgagctcaagtgatccacctgccttggcttcccaaagtgttgggattacaggctgagccactgcgcctagccaacacactgcttacttytaagagttcctgctttgattcagttttagcctctgagcatccttaccaagtagtcaactcattcattccatttaagggctagttttttattgcactcagc

SEQ ID NO: 67554 - DNA, 201 bp, Homo sapiens
caggatgtttttcagaaaggttatatagacatatgagactagatggtctggtaaaagaatgacaggtgatagacaaaaggcaaacaaaaaatataatcagraggtaataagtgctatgaagaaaagaaaagcaggataggggaataggttgagaagagagaactatttaacggcttgtagcaccaggatctccatagttaa

SEQ ID NO: 67555 - DNA, 201 bp, Homo sapiens
attacaggctgagccactgcgcctagccaacacactgcttacttctaagagttcctgctttgattcagttttagcctctgagcatccttaccaagtagtcractcattcattccatttaagggctagttttttattgcactcagcatttttaattgttgctagcaggaaggttagtcagatgtcttagaccacaggaccac

SEQ ID NO: 67556 - DNA, 201 bp, Homo sapiens
attcagttttagcctctgagcatccttaccaagtagtcaactcattcattccatttaagggctagttttttattgcactcagcatttttaattgttgctakcaggaaggttagtcagatgtcttagaccacaggaccactgtattgccagaatctaaagtcaaaaatccgctttaaaacataaagctaattatgtcactct

SEQ ID NO: 67557 - DNA, 201 bp, Homo sapiens
attaagaggtatgatagttgatacagtttggctgtgtccccacccaaatctcatcttgaattgtagctcccataattcccatgtgttgtaggagggacccrgtggaaggtaattgaatcatggggacaggtctttcccatgccattctcatgatagtgagtaagtctcatgagatctgatggttttataaaggggagttct

SEQ ID NO: 67558 - DNA, 201 bp, Homo sapiens
ctgaggcaggagaagggcatgaacccgagaggcggagcttgcagtgagccgagattgcccagtgcactccagcctgggcgacagagcgagactccatctcaaaaaaaaaaaaaaattttgtcactgtatattatcatatttaaaatttttgtaaattaatgggaaaaaaagtaaacttccttaatttacattcactgacta

SEQ ID NO: 67559 - DNA, 201 bp, Homo sapiens
caagaacatacagcaaaattaatgctatcattcatagtggaccccctctatcatcacagagaaaatcattgatgaccagcactgactccaatattacccargatctatatttagtatgtctttaggagcatcatggttccttattcagaggatgagattgtatggaaatggcctatcccatgcagttcagcacaaggagac

SEQ ID NO: 67560 - DNA, 201 bp, Homo sapiens
ttattagcagcatgagaacgaacgaatacgatagtattacaagtaggtgctctgccttcatgaatgggattagtgcccttacaaaaaaggcttgagggagsctgtttgttccctttcaccatgtgaggatgccataagaaggcaccatctgtgaagcagacagcaagctcccaccagacactgaatctgctgatgccttga

SEQ ID NO: 67561 - DNA, 201 bp, Homo sapiens
ctggttatagaagaatggaccagaagcaaacacctggtccctggtgggccaatcaatttctctctccctgacagctagaattgaaatttgaaaataccagyctcagccaggtgcattggctcacgcctgtaatcccaacactttgggaagctgaggcaggaggatcacttgaggccaggagttcaagactagcctcagcat

SEQ ID NO: 67562 - DNA, 201 bp, Homo sapiens
ccatagttccctttaactctttaacttcatctgctcaaaacacttttttaaaacatctcaaatctcttctcccatgatctctatctgagctcatgatatcrccatccacctgcttccccaagcccaagctttggaagccacagtgaatgtgaggcactattggctaacatgtaacagtgaccatgtgacagtaattgttaa

SEQ ID NO: 67563 - DNA, 201 bp, Homo sapiens
aaaataccagcctcagccaggtgcattggctcacgcctgtaatcccaacactttgggaagctgaggcaggaggatcacttgaggccaggagttcaagactrgcctcagcatcatggcaagaaaattagctgagcatggtggcatgcacctgtagccctaggtacttgggaggctaagacgggaggatcacttgagcccagg

SEQ ID NO: 67564 - DNA, 201 bp, Homo sapiens
ggtgaaagcccatctctactaaaaatataaaattagccaggcatggtggcatgcacctgtaatcccagctactcaggaggctgaggcaggagaatggcttraacctgggagatggaggttgcaatgaactgagaccacaccactgcactccagcctgggtgacacagtgagactccgtctcataaaaaaaaaaaataaagg

SEQ ID NO: 67565 - DNA, 201 bp, Homo sapiens
cccacagtgcacagcacagttccgagccgcaaaggcttgcagtacccaaaatgccatttgccattttcacaaaaacccagttcattctcatctcaagatctttttttttttttttttgagacagagtctcgctctgtcgcctaggctgcagtgcagtggcacgatctcggttcactgcaacctccgcctcccgggttcaag

SEQ ID NO: 67566 - DNA, 201 bp, Homo sapiens
gggagggagggagggagggaggaaaggaggaagggagaaagagaagcagaaggagaagaagaaataagaaagcttccacgctggtttccatgagccactckgtaatcctcctcatcactgctctctggccacacttcgtgggctctgtcactgcgtgcccttcctctgtctgctctgaggcctggcactccctaggtctcc

SEQ ID NO: 67567 - DNA, 201 bp, Homo sapiens
tcttgaccctgttcaagaggcataagggaaacttcccagaggagaaagaaaatggaggttaaacttgaaccagcaggaacagagagaaaagaggagagcasagaaacagccaatgaatcctaattaacaaatcaaatgggcaggagaatattcaagtctagtatggaaagagctcaacattcaagggtctgatcaaccatt

SEQ ID NO: 67568 - DNA, 201 bp, Homo sapiens
attttcacaaaaacccagttcattctcatctcaagatctttttttttttttttttgagacagagtctcgctctgtcgcctaggctgcagtgcagtggcacratctcggttcactgcaacctccgcctcccgggttcaagcaattctcctgcctcagcctcctgagtagctgggattacaagcgcctgccaccacacccagc

SEQ ID NO: 67569 - DNA, 201 bp, Homo sapiens
tataggcttacaactggactttaaaatatgattttatttaaatgtcacggagcagcctggcgtggtgactcacacctgtaatcccagcactttgggaggcygaggcgggcagatcacctgaggtcaggagttcgagaccagcctggccaacatgacgaaaccccgtctctactaaaaatacaaaaattagccgggaatggt

SEQ ID NO: 67570 - DNA, 201 bp, Homo sapiens
aactctgacactaatttttctcttggttcacctaagacatctataatgtaactttattgttctacatttcagatcattttctggcaatgcttctttgacawagcatacaaattttgcaacatgaagcaatatacatttcttgacttcaaaaaaatatggtttccccataatgtatatgaaaacatatcaaaggtgggttac

SEQ ID NO: 67571 - DNA, 201 bp, Homo sapiens
agagaataatcttaatgatgaaatttttttaaggcttagaaaactaatgaagccctcaaatatggtgtgagatctctttataagaatgctgcaagagtcakatgtgaagcgaaggctgttgtaatatgccttttttatagaaaaacaatcatgctataaataacaataaagcatttttaatttgaaaaattagttgactgc

SEQ ID NO: 67572 - DNA, 201 bp, Homo sapiens
aggatctccatagttaagcctcatggagtgccactgtgaacacagcaaaggcaatgcaaattgaatgcacaatgaagtttcaaattgtgctgcatgcaagrtttcataaagtccacaagagatggctccaacaacatcaaaagtccctgacagataaagatctggcagcattagactgtcaacaattgaagaaaagaaaat

SEQ ID NO: 67573 - DNA, 201 bp, Homo sapiens
aatgcaaattgaatgcacaatgaagtttcaaattgtgctgcatgcaaggtttcataaagtccacaagagatggctccaacaacatcaaaagtccctgacarataaagatctggcagcattagactgtcaacaattgaagaaaagaaaataagaaaagctgtctatattttgggtgcttcatgagagaataatcttaatgat

SEQ ID NO: 67574 - DNA, 201 bp, Homo sapiens
ctataatcccaggactgtgggaggctgaggtgggaagatcggttgagcccagagtttgagaccagcctgggaaacatagtgacaccttgtgtttacagaatttttttttttttttttttttttgagatggaatctcgctctgtcgcccaggctggagtatagttgcgccatctcagctcactgcaacctccacctcctggg

SEQ ID NO: 67575 - DNA, 201 bp, Homo sapiens
gggaagatcggttgagcccagagtttgagaccagcctgggaaacatagtgacaccttgtgtttacagaatttttttttttttttttttttttgagatggartctcgctctgtcgcccaggctggagtatagttgcgccatctcagctcactgcaacctccacctcctgggttcaagcaattgtcctgccacagcctccaca

SEQ ID NO: 67576 - DNA, 201 bp, Homo sapiens
taaaaagaaacattttacctggtgtcctttcagatcatcagtctctctgctcagtcaagcacaattcttttaatccctatcttcatccacttgtctctctmaaattgattgggcttctcctaggatcttcatgtttgtacaaagaaagcccaagctaaattttcaaggtcaaggaaaaaacatacgcttttccctgcctag

SEQ ID NO: 67577 - DNA, 201 bp, Homo sapiens
tgccattctcatgatagtgagtaagtctcatgagatctgatggttttataaaggggagttctcctgcacacaccctcttgcctgctgccatgtaagatgtrcctttggtcttccttcaccttctgccatgactgtgaggcctccgcagccacctggaactgcaagtccattaaataaattacccagtcgtgggtatgtctt

SEQ ID NO: 67578 - DNA, 201 bp, Homo sapiens
gactgcagggcatcaggggctctcaaagccaagagtgaagaatcagaggggtctgtaagagatcagggacattgggagcagcatctatccaaccacgcagaaggacagtgggtgcccaaaccaaagggccaattaggcaacctggtcacaataggagttagactgaggagctgccactccctaattcacaggagcccagaa

SEQ ID NO: 67579 - DNA, 201 bp, Homo sapiens
tggaatcatgggaaaaaatttaaattagatttctacctcacaccaaacacaaaaatcaattccagggagaattaaagatttaaatataaaagtcaaaccakaagatattcagaagacaatataggtgcatgtttttatgacttcatggaaaggatttcttaagaatagaaaaatacaacctagaaacacaaaagagtgata

SEQ ID NO: 67580 - DNA, 201 bp, Homo sapiens
tgatatattatgacaggaaaaaaactcaagtattttggcttgaaaatataaactataaacatataggaaaaattttggtttaaaactaagcacaaattacrctggttttttttaagaaaaggaacaattatatttttcataatactaaaaatgaaataatgtaaagtgataaaaagcaattaattcctacttaggtaatat

SEQ ID NO: 67581 - DNA, 201 bp, Homo sapiens
gcactccagcctgggcgacagagcgagactccgtatcaaaaaacaaacaaaacaacaacaacaacaacaaacaagatgttgtattcttgacatttaggcawtttctaaaatattacattttttataaaatttctctgccatggaaaaaaaatccacctttgccagagcaaaggaagccagtgaaagaagtaattcattggg

SEQ ID NO: 67582 - DNA, 201 bp, Homo sapiens
tcggctggtataagaccttatagaagactctgaaaactgaaacacgccaacaagttttctgttaccagtattttttttttaactctgtgcccaggccaggmgcggtggctcacgccggtaatctcagcgctttgggaggccgaggcgggcggatcgcgaggtcaggggtttgagcatcctggccaacatggtgaaaccccg

SEQ ID NO: 67583 - DNA, 201 bp, Homo sapiens
cttatagaagactctgaaaactgaaacacgccaacaagttttctgttaccagtattttttttttaactctgtgcccaggccaggcgcggtggctcacgcckgtaatctcagcgctttgggaggccgaggcgggcggatcgcgaggtcaggggtttgagcatcctggccaacatggtgaaaccccgtctttactaaaaatac

SEQ ID NO: 67584 - DNA, 201 bp, Homo sapiens
cggggaaggggaggggaggggaatggaggggaggagggggagaggagaggagaggaggactcattcacctctagccctctgatgccacacagaaatgtggrcccaaggctctgtgaaatcttccagttttttgagactggcctgaaatcctgtttatgtgattctgtttcttgaaaaaagcagctccctaaatcaaaatgt

SEQ ID NO: 67585 - DNA, 201 bp, Homo sapiens
tcattttctggcaatgcttctttgacatagcatacaaattttgcaacatgaagcaatatacatttcttgacttcaaaaaaatatggtttccccataatgtrtatgaaaacatatcaaaggtgggttacattattaaattctgtaacttgtatattaataacttatgaagtctatgaattattatgtaccaatgatgcaaga

SEQ ID NO: 67586 - DNA, 201 bp, Homo sapiens
cgcccaccttggcctcctaaagtgctgggattacaggcctgagccatcacgccaggctgtcaataaacttttatgttgacatacttcaatagagtttcagwcaatccctcttttccctccctaatttttcctatttgaaaagaatccgctctctcctgttttgttcagcaaaatgtaaaacattgataagatttatacctt

SEQ ID NO: 67587 - DNA, 201 bp, Homo sapiens
tttaggagcatcatggttccttattcagaggatgagattgtatggaaatggcctatcccatgcagttcagcacaaggagacccagtgcagtacaggaacamtgtatgaaatgcttaaaaatgactattcattgcacattagagaatgcctatgtcacatttttacaattacagaactcttttttttttttttggagacaga

SEQ ID NO: 67588 - DNA, 201 bp, Homo sapiens
gagatggaggttgcaatgaactgagaccacaccactgcactccagcctgggtgacacagtgagactccgtctcataaaaaaaaaaaataaaggaggggagmggggaaggggaggggaggggaatggaggggaggagggggagaggagaggagaggaggactcattcacctctagccctctgatgccacacagaaatgtggg

SEQ ID NO: 67589 - DNA, 201 bp, Homo sapiens
actaatttttctcttggttcacctaagacatctataatgtaactttattgttctacatttcagatcattttctggcaatgcttctttgacatagcatacamattttgcaacatgaagcaatatacatttcttgacttcaaaaaaatatggtttccccataatgtatatgaaaacatatcaaaggtgggttacattattaaa

SEQ ID NO: 67590 - DNA, 201 bp, Homo sapiens
cagccttttccattaaaactttaacttttatgtgattatgaggttatttatacctaaagagaccatttatgtatatagagaattagtacaggcatttattyttccagggactgagataagaggaaaataaccaagggaagaatttgttcagcactagaggcaatatttcagatgcttaagtggaaatacgcatatgcttcc

SEQ ID NO: 67591 - DNA, 201 bp, Homo sapiens
ctgctcagaattcaggactcacaccaagtaatggtgagtgctacatgccagactaaggagcttgactgtcaagaggaggttgctgacaaaagtgggagttkaagtggtgtttaaagaactgatctaacagtggtgggtaagaggcactgggaagaaaaccagagcagtgattcttaaccaagagcacgtatcagaatcatc

SEQ ID NO: 67592 - DNA, 201 bp, Homo sapiens
agccttttccattaaaactttaacttttatgtgattatgaggttatttatacctaaagagaccatttatgtatatagagaattagtacaggcatttatttytccagggactgagataagaggaaaataaccaagggaagaatttgttcagcactagaggcaatatttcagatgcttaagtggaaatacgcatatgcttcct

SEQ ID NO: 67593 - DNA, 201 bp, Homo sapiens
gaactgagatcgcgccactgcactgcagcctggatgacagagcaagagtctgtctcaaaaaaaaaaaaaagaattagatcacagccccaataagatttctrgtaacatctaattagacaattgagttcccttgctggagcttgtctgctttgcttataaaaacatgtgcaaagtctaagacaaccacaactagaccctcaa

SEQ ID NO: 67594 - DNA, 201 bp, Homo sapiens
ggaattaatatacatgcaaattttctgcatgcaaactctaccttcctggtcactttgaaggatataaattaatcaaaatcacaaaattcttcaatcttatrtaagaatgtacaataatgccactgaagcaatttagaacttacaatgcccatagcatagaatctattatatatagatatctaattatatctatctaaacac

SEQ ID NO: 67595 - DNA, 201 bp, Homo sapiens
agccgagattgcaccactgcgctccagcctggcgacagagcgagactccgtctcaaacaaacaaataaacaaaaaaaccctttgtgcccaccgtatgctakcgtaaaagtaatctgaatttgaaagtcaatcagcaagtatttactgagcgacgtgtaagggataaggaaaaggtctaaagcagcttatctagtttaggga

SEQ ID NO: 67596 - DNA, 201 bp, Homo sapiens; identical to SEQ ID NO: 43455

SEQ ID NO: 67597 - DNA, 201 bp, Homo sapiens; identical to SEQ ID NO: 43502

SEQ ID NO: 67598 - DNA, 201 bp, Homo sapiens
tgatcccacatcacactgaaccatcaccagccagaatctgagatatggatcactggctctgccctctgctgggcacaattttctaacaggttactcagctrtggactaactaaatgagatggagggaagccatgttagaaaactttggcccaatgaactgtattattccggtgtgctttaggagaatatgatttagaagga

SEQ ID NO: 67599 - DNA, 201 bp, Homo sapiens
ttatatgaaatatctagaataagcaagtctgtagagccagaaagcagattattgattgctagggaatgtgagaggggaaaatggggaatgactgcttggcrgtatgagatttccttttcgggtaatgaaaacgctctggagcagcatagtggtaactgtcacatgatgctgtgaatatacgaaatgccactgaattgtaca

SEQ ID NO: 67600 - DNA, 201 bp, Homo sapiens
atcatatactatgttctcaggaaaaattagtttacatattaaacacagagaacgctatggattttaaatttcagctgttatataaaccctctttcattatmatttctactgaatagatggtattttagattaaaatcagatactaattattctaatactcacatattgaatttctgccctgtcagtatttccatgagtgtc

SEQ ID NO: 67601 - DNA, 201 bp, Homo sapiens
aaaagggaccgtggaaaagctgggccttacctgactatggaggcagtccagtggccatttccaagaccaggagccatgtgagagctcagcgatgtgaaatkcactgaatccaagtcttagataatgactagggctaaggctctttcaacgaagtactgagacgtaaaacctttataacttcaattaggactgaggtgaaac

SEQ ID NO: 67602 - DNA, 201 bp, Homo sapiens
gaattatatatagtaacatcttagtgatgcttacataatttttacataaaatttttattttcttattttacctatctgtattttccatttttatgaatgtmtatgtgttactttgtggttagaaaaaaagatattacaaacaacaaaaattaagtccttttaatgtttacataacactaagtatatgtcaggtcatcagaa

SEQ ID NO: 67603 - DNA, 201 bp, Homo sapiens
taggcctggctctgatgctgcctaaatgtgaattatttcagttatataattgcatcagagtttttctcacctgagagataagaaggcactattaggaaggrtctcttactttcaactctcaacaatttttaattaaaagtgtattttcccttcatgatatataaattttaaaatcagattagaaaatcatatttagagtat

SEQ ID NO: 67604 - DNA, 201 bp, Homo sapiens
aactttcctaaaattcccaaaacctcttgatatcacaaaaccccaaaaaagtgctctgctagatgtttttatacaaagaatgtacagataatgtcactctrgtactaaatttagcaaataaaattgattgattgataagattcattgaatctattttagagcctttaactcaaatttcttcagcataaatggttttttgaa

SEQ ID NO: 67605 - DNA, 201 bp, Homo sapiens
ccttgagaaatttcaaactaaaagtcatcataaactcctggcatgagaattatgttttcatgatggaactatagcgtaatcattgtcagttactaattacmatcttgagacagagtcagtggggccaaaaaagaaagaaagggagaggagagagagagagaaagggggagagagagagaaagggggagagagagagaaagg

SEQ ID NO: 67606 - DNA, 201 bp, Homo sapiens
ggagagagagagaaagggggagagagagagaaagggcgagaaagagagagaggagggaagagggaggaagggagggagggggaggaaggaaggaaggaagkaaagaaggaaggaaggaaggagggaaggaaaagaaggaaagaaggaaaggcaagaattaagttcatgcattctcagagcaagttactttgacccttggaa

SEQ ID NO: 67607 - DNA, 201 bp, Homo sapiens
atcatttgtaatcactatttccgtttgagaaaataaatcacttccaaattatctgaatctccctccaaataaccaggcttttttttttagtttaacatcawaaaatgtctatgtaagtgaatgccatttgtataacctgattttactcactgatttcactatctcctgtagcaaagaaaaactgaaaaaaataagtgaaat

SEQ ID NO: 67608 - DNA, 201 bp, Homo sapiens
ggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttccaagaacattcacccttgatctgaa

SEQ ID NO: 67609 - DNA, 201 bp, Homo sapiens
taaataattgtatttacatggtcacgtcagaacctgttgagggtaataagagtaatgcactgtaattaaaaccgaagctctttggtttttgtctggcacamgcatagagctcagtttctgtatgcacctaataggaccatgtcatggcaatgacattgtctgcttagaaatccattgcttatatttttgttatttctcaac

SEQ ID NO: 67610 - DNA, 201 bp, Homo sapiens
aggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttccaagaacattcacccttgatctga

SEQ ID NO: 67611 - DNA, 201 bp, Homo sapiens
gagaagttgggtggaaggggtctagaacctagtgaaatctaaaaggttcctgacaagactgtcagggcatcttgatctgaggtgagcacctggaacaggcktgctttagcattcccgccctgctcagtcactggctggaagcagcttataggaagcaagacctcagcataaacagagcaccatagactgaatgtttctgtc

SEQ ID NO: 67612 - DNA, 201 bp, Homo sapiens
tgtgtaagaactgaagaggaggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttccaaga

SEQ ID NO: 67613 - DNA, 201 bp, Homo sapiens
aatgtgtaagaactgaagaggaggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttccaa

SEQ ID NO: 67614 - DNA, 201 bp, Homo sapiens
ttctgttattatattttgaattttagacattatcatctctgattgtctgtcaatgtccttagcttctcactcctaaaagtaaaattaaagttggattttgycttttttcttaatccctcagccctgttgtaacacagccagccacaaataaatttaagtaagtggctttatcaaaagccaaaaatagatgctttcaaaata

SEQ ID NO: 67615 - DNA, 201 bp, Homo sapiens
aagtgtcaaaagaatgaactggtggacacatcctccatgggctgaggcaaggaagaaagattctggttatttctcataatctgcaattctgatcccacatyacactgaaccatcaccagccagaatctgagatatggatcactggctctgccctctgctgggcacaattttctaacaggttactcagctgtggactaacta

SEQ ID NO: 67616 - DNA, 201 bp, Homo sapiens
caaatgtgtaagaactgaagaggaggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttcc

SEQ ID NO: 67617 - DNA, 201 bp, Homo sapiens
aaactagaccgtggttttcaaacagcagacgaattgagaccagactacattctaaactcccccaccttctggtttcattacgctcttgaaacccaagtcamttttataaaaagagttgataaaactggtcttaattcttagcaaacctgacccagttagaacttgaagctggagtgaattcagttttaatttggggtgcag

SEQ ID NO: 67618 - DNA, 201 bp, Homo sapiens
cagcattaatcacaacagccaaagtggaaacatcccaagtgtccatcaactgatgaatggataagcaaaatgtactctatctacaccacggaatattattyagccataaaaaggaatgaaggtgcatgctacaacatgggtaaactttgaaaacattatgctgagtgaaataagccagacacaaaaggacacgtattgtac

SEQ ID NO: 67619 - DNA, 201 bp, Homo sapiens
acatggtgaaacctcatcactactaaaaatagaaaaattagctgggcgtgggggcgcacacctgtagtcctagctactcgggaggctgaggcatgagaatsgcttgaacctgggaggcagaggttgcagtgagctgagatcacaccactgcactccagcctgggcaacagagcgagacgtctcaaaaataataataataat

SEQ ID NO: 67620 - DNA, 201 bp, Homo sapiens
atatgcaaagtgactggaaagaaattttagcttcattaccattaaagggtgaaaatatgggctgggcaagaacccagttaaataaatgtggtagattaatwttcagtccctaggaaactataagccaatcataaaatcaggtaaaaaatggatgcttctgagctgtggactttgtcagtcctttagtggggaaacagagta

SEQ ID NO: 67621 - DNA, 201 bp, Homo sapiens
tgaagtatcttcagaattccaaaagaggtagagtttaaagagtaactgggttgtttacttaattgtaaaattcctcagcttatatagctcattctgaactkaattcagcttttcagatttttgaactttttccctaaacctcctccaattatcctttacccaactagtataccaaaacaattttaaaaaaatcaacctttt

SEQ ID NO: 67622 - DNA, 201 bp, Homo sapiens
atgatttagaaggagctggttacattaagtagctttccttagtagacccatttcacagattatgttctaagaggaaaatctctggcccaacacttcagccrtaaggaagaaactaaataattgtatttacatggtcacgtcagaacctgttgagggtaataagagtaatgcactgtaattaaaaccgaagctctttggttt

SEQ ID NO: 67623 - DNA, 201 bp, Homo sapiens
gttattggcttggcaggcaagagaggaggtgggggcagattctgaagtggcacctcttacaggggtgagatttctatagcatcttccagcactgtagaacygctagcctttactatggaaggtgagccacatctgcaagcccagaggatctgagggggttgaagaatgaacatcctcagggtgccatccagatgtccccat

SEQ ID NO: 67624 - DNA, 201 bp, Homo sapiens
aataaatttaagtaagtggctttatcaaaagccaaaaatagatgctttcaaaataggtaagcttcttattttacagatcaggaaactgatattgagaaggyaattgacttgcccagggtctcatattcagatcttattctttcattgtcaaggagaaataaacagaaagggaagggtaaatagtcccatatttgacccacg

SEQ ID NO: 67625 - DNA, 201 bp, Homo sapiens
acctctaaaagtcttcactgaaacttcccaaccactagagcacatatgttttcccaagacaccacacactagtcacctcttgctcaacttgtccaatcatmgtgatgttgtcaatgtaatagatcagagtgatgttctgtggggtgttcaggcagtccagttccttcagactcaccatcacagagggtggcagaaacatag

SEQ ID NO: 67626 - DNA, 201 bp, Homo sapiens
tagagctagaagaaatgttagtgagttctgctgtctcattttaaagagagaatatgaaggcccaggaaggtgaaatgatttacccaaatcacccacacagyctgctggtggcagaaccaagatgagagtccaagggcccttgactctaatgtgattttcttctcactgcctttaccatcattcaccatcttccccagaacc

SEQ ID NO: 67627 - DNA, 201 bp, Homo sapiens
ggcagggaaaggtggaagaaggtagatacacgaggatggggaggagagcgattgcagaaagatgaaatggtgttctctctccagcaagtcaattttgaaayatcaagttaaaaaaaaaatttcttgagaaccaaacgtgtttctccaaattctagccaaaaataaggcgcaagcacgcacacgcacaagcacacccgccaa

SEQ ID NO: 67628 - DNA, 201 bp, Homo sapiens
ccactgacagtacctgctaagaattaggttgtcttctccctcatctgtctgtagtttgtacttcgtcctaattctggcttttgatagtgatatctctagamcaccaccaggtttctgagcacgccatatattcatttctaggtatcaccactgcttaacgaacccaaatagtcccttggttctcccaactgcaatagagtc

SEQ ID NO: 67629 - DNA, 201 bp, Homo sapiens
tcttgcctcaaccatgtttactaacgtagagcctctggttcctatcttcctgtattccaaaagcatccagctcaaaatgcatatctatctgctgaagtccsacatcaccatcagctccacccagaggtagatttaggattcacaaacttttaagttatctatgccttttcagcagaaatagccatgctaaccaaccctttg

SEQ ID NO: 67630 - DNA, 201 bp, Homo sapiens
tttctgtgaacaggtattaatcctggagccaggaaaggctctgagaagtgaaagaacaccacgaacaaagtcttaagatggggcctgtaagctcagccagygtgaggtcaccctcaccgagacgctcggtggcagctccagccaccgcacagccctctgcagtgatgggaacagggtgagggcagccagagccttcccacc

SEQ ID NO: 67631 - DNA, 201 bp, Homo sapiens
ccagggcaaaggcatttgcctcagacctttgcccggctactctagttctgagaacctgccctaaataaaggaggtaattctgaactgggagacatgccctytgtgctccaggatattcactgcagtgtcatttacagtggctaaggaggaaaggggagggcagaggggaggcagcagggagaggaaggaggtgggggagag

SEQ ID NO: 67632 - DNA, 201 bp, Homo sapiens
gagtggacctgcagagccacgtctgtccctctgtctgtcgaccacagccggtgccagcaattcaggaggcctagtgggcgagggaggctggggaaaggackggagggtgggaggaggagctcggccacaggaaataaggggcctgcaggtggctggggcgccccagggcaaaggcatttgcctcagacctttgcccggcta

SEQ ID NO: 67633 - DNA, 201 bp, Homo sapiens
gggctgtgctgggctctttctcagcctggcccgaagtttccagatctgattgagcgagagagcagcaggacctgcccctctgctgggctcttaccttcgcrgcactcgccactgcccagcagcaggtgaggcccaacacaaccagttgcaggcgccccatggtgagcatcagcctctgggtggccctccccctgggcctcg

SEQ ID NO: 67634 - DNA, 201 bp, Homo sapiens
ccgagtggacctgcagagccacgtctgtccctctgtctgtcgaccacagccggtgccagcaattcaggaggcctagtgggcgagggaggctggggaaaggmctggagggtgggaggaggagctcggccacaggaaataaggggcctgcaggtggctggggcgccccagggcaaaggcatttgcctcagacctttgcccggc

SEQ ID NO: 67635 - DNA, 201 bp, Homo sapiens
atgtgagaggatgtggacgcagatgtggacgtggaagaggtcaagttagacaaggatttaagagctgaccaaggctagagagggatcaatgtgagagatgyaaaaaaaaaaaaaaaaaaaaaaaaaagggggcactggaaggatgaatgtccagaaggcaatgagggaaatggccaaggccgtgagacaaagaggccattg

SEQ ID NO: 67636 - DNA, 201 bp, Homo sapiens
tgaatgctctaaaacccccctgggctccattgattcattccttcctcactcaaatcccttgaagcggctacattgtctggtctacatacccggggtttgtygtcatgcaccaggaaaatttaggacagggacaaacacgaggactttaggagcggaggtttaatagatagaagagaagaaaaagagaaacatctctctctt

SEQ ID NO: 67637 - DNA, 201 bp, Homo sapiens
cagggtgagggcagccagagccttcccacccaacagtcccccaggagacactggggcctgtgcttcccacaccaaccacactcccgttctgccacccctgmggccggtgccagggaccgagtggacctgcagagccacgtctgtccctctgtctgtcgaccacagccggtgccagcaattcaggaggcctagtgggcgagg

SEQ ID NO: 67638 - DNA, 201 bp, Homo sapiens
tcggtggcagctccagccaccgcacagccctctgcagtgatgggaacagggtgagggcagccagagccttcccacccaacagtcccccaggagacactggrgcctgtgcttcccacaccaaccacactcccgttctgccacccctgcggccggtgccagggaccgagtggacctgcagagccacgtctgtccctctgtctg

SEQ ID NO: 67639 - DNA, 201 bp, Homo sapiens
gggcaggggagagggaaaggaaggccccactttttatatatatacatttttagagcagatttaggttcacagcaaaattagaagaaggttacagagatttyccgtatgtcctcgccccaacccagtctcccccattatcaacatcccccaccagggggtacagctgttatactttatgaacctacattgacatgtcataat

SEQ ID NO: 67640 - DNA, 201 bp, Homo sapiens
cacttacctgggagcagaggcaggtggcaaggtggcgggtggtaagggggatggtggggccgggcagggtgcacagtgccctgccttctggtttgttcacrgggcttggtgtcactgtcagagaaaagggcatactttgtctccatgccctgcctgtcccctaggtccccagaggggcttcacaggggaccaagcacgtga

SEQ ID NO: 67641 - DNA, 201 bp, Homo sapiens
agagaaacatctctctcttctccaagcataaaggactggtgggcagcagacacactgaattttatattcaggtttgtccttgcccagccctgccagccgactgcaggagcaggagaactaaggaagggaaaaggaagcagatgaaaggcttaagaaaaaggcggatctgttggcagcagcccttatagaaagagaaattag

SEQ ID NO: 67642 - DNA, 201 bp, Homo sapiens
ctggggcaggggagagggaaaggaaggccccactttttatatatatacatttttagagcagatttaggttcacagcaaaattagaagaaggttacagagakttcccgtatgtcctcgccccaacccagtctcccccattatcaacatcccccaccagggggtacagctgttatactttatgaacctacattgacatgtcat

SEQ ID NO: 67643 - DNA, 201 bp, Homo sapiens
gccctaaataaaggaggtaattctgaactgggagacatgccctttgtgctccaggatattcactgcagtgtcatttacagtggctaaggaggaaaggggarggcagaggggaggcagcagggagaggaaggaggtgggggagagggctggggcaggggagagggaaaggaaggccccactttttatatatatacattttta

SEQ ID NO: 67644 - DNA, 201 bp, Homo sapiens
cggacccgggtgtggagtagctcggctttcagcttcctgcacaggaataggaggcagcagctgtgccatgctgggcaaactgcctgcctgcttctctccasccgtctgcctgctctccacactccctgcccctgggcccgtttccccttctgtaaaatgggaacaacagagaggttggtaggtggaatcaccaggattagc

SEQ ID NO: 67645 - DNA, 201 bp, Homo sapiens
cttccctgaggaaagaaaggacacagccaaggccctggggcatgcccaggcagagtgacaggagagaaaaggaggccagcgggagggaagggagaaggtcstgtgaggttgtggaggaagaggaggccactcgtattttctgtgaacaggtattaatcctggagccaggaaaggctctgagaagtgaaagaacaccacgaa

SEQ ID NO: 67646 - DNA, 201 bp, Homo sapiens
gaggccactcgtattttctgtgaacaggtattaatcctggagccaggaaaggctctgagaagtgaaagaacaccacgaacaaagtcttaagatggggcctktaagctcagccagtgtgaggtcaccctcaccgagacgctcggtggcagctccagccaccgcacagccctctgcagtgatgggaacagggtgagggcagcc

SEQ ID NO: 67647 - DNA, 201 bp, Homo sapiens
ctggtctacatacccggggtttgttgtcatgcaccaggaaaatttaggacagggacaaacacgaggactttaggagcggaggtttaatagatagaagagargaaaaagagaaacatctctctcttctccaagcataaaggactggtgggcagcagacacactgaattttatattcaggtttgtccttgcccagccctgcca

SEQ ID NO: 67648 - DNA, 201 bp, Homo sapiens
tcctgagggcctcagggtggggaaatggggaggggtcgtgatgacctgccgaaggcctctcagcaccccaagaagagctcgcccaagaagaaggtgacctstcctttgagtcaggagcccaggaccactgcccaaacctcccggtcccagggccagggagtgtggagagcaggcagcagaggtggagacaggagtccccag

SEQ ID NO: 67649 - DNA, 201 bp, Homo sapiens
gctgtgggccccccacccaagtggctgaccttatctgtacgagcttttcctggggccatggagcaagcagtccaagctgggtgcgggtcccagagcagcayaaagccgtctcattcaagggtggggagatgtcaccatccagcctgatgcatcctgggagggaggactagaggctcagggggtgtgggtgggggggtgcgg

SEQ ID NO: 67650 - DNA, 201 bp, Homo sapiens
aggtctgcattgtactccagacccctggacgggcccctagaggacccagtggctgctgaggcaggcggggcctggctgtcactgggcccagcacagcaggytttgcttctagcggggccgtgggggttgctttgtttgggcttgtccatcctgagggcctcagggtggggaaatggggaggggtcgtgatgacctgccgaa

SEQ ID NO: 67651 - DNA, 201 bp, Homo sapiens
gtggaggaagaggaggccactcgtattttctgtgaacaggtattaatcctggagccaggaaaggctctgagaagtgaaagaacaccacgaacaaagtcttmagatggggcctgtaagctcagccagtgtgaggtcaccctcaccgagacgctcggtggcagctccagccaccgcacagccctctgcagtgatgggaacagg

SEQ ID NO: 67652 - DNA, 201 bp, Homo sapiens
gaagccactgagggaactgatggagaaggagctccctctctcagggctgggttccagtccatcagccaaaaatggtgggaggtctgcattgtactccagasccctggacgggcccctagaggacccagtggctgctgaggcaggcggggcctggctgtcactgggcccagcacagcaggctttgcttctagcggggccgtg

SEQ ID NO: 67653 - DNA, 201 bp, Homo sapiens
caaggccctggggcatgcccaggcagagtgacaggagagaaaaggaggccagcgggagggaagggagaaggtcgtgtgaggttgtggaggaagaggaggcsactcgtattttctgtgaacaggtattaatcctggagccaggaaaggctctgagaagtgaaagaacaccacgaacaaagtcttaagatggggcctgtaagc

SEQ ID NO: 67654 - DNA, 201 bp, Homo sapiens
tgaagcaggaaggaggaaacttagaagccactgagggaactgatggagaaggagctccctctctcagggctgggttccagtccatcagccaaaaatggtgsgaggtctgcattgtactccagacccctggacgggcccctagaggacccagtggctgctgaggcaggcggggcctggctgtcactgggcccagcacagcag

SEQ ID NO: 67655 - DNA, 201 bp, Homo sapiens
gcctgtcccctaggtccccagaggggcttcacaggggaccaagcacgtgacttctgggacagagagggtgacatgctgtgggccccccacccaagtggctkaccttatctgtacgagcttttcctggggccatggagcaagcagtccaagctgggtgcgggtcccagagcagcataaagccgtctcattcaagggtgggga

SEQ ID NO: 67656 - DNA, 201 bp, Homo sapiens
catttttagagcagatttaggttcacagcaaaattagaagaaggttacagagatttcccgtatgtcctcgccccaacccagtctcccccattatcaacatsccccaccagggggtacagctgttatactttatgaacctacattgacatgtcataatcacccagagtccacagatttaggggtttttttgtttgttttgag

SEQ ID NO: 67657 - DNA, 201 bp, Homo sapiens
tgcctgtcccctaggtccccagaggggcttcacaggggaccaagcacgtgacttctgggacagagagggtgacatgctgtgggccccccacccaagtggckgaccttatctgtacgagcttttcctggggccatggagcaagcagtccaagctgggtgcgggtcccagagcagcataaagccgtctcattcaagggtgggg

SEQ ID NO: 67658 - DNA, 201 bp, Homo sapiens
cacagtgccctgccttctggtttgttcacagggcttggtgtcactgtcagagaaaagggcatactttgtctccatgccctgcctgtcccctaggtccccaraggggcttcacaggggaccaagcacgtgacttctgggacagagagggtgacatgctgtgggccccccacccaagtggctgaccttatctgtacgagcttt

SEQ ID NO: 67659 - DNA, 201 bp, Homo sapiens
ggtatttatggagctggatccaaggtcacatgcttgttcatgagctctcaggcactccctcccctctacaccctcaggtgcagggagatccagttttcccmaaacccacagtgcacctgtgcaggttaccacttacctgggagcagaggcaggtggcaaggtggcgggtggtaagggggatggtggggccgggcagggtgc

SEQ ID NO: 67660 - DNA, 201 bp, Homo sapiens
atactgaatattacctcactaataacatctgagatgagaggcaaagattatgactatcaggaataaccagaatttggggccaaattgtcttcattgtaggwctaacagagaccagatccatcttctggttatttattcattttccaaatgtgtaggtataattgacaagtctagcaatgatcagaattcccactgtggctc

SEQ ID NO: 67661 - DNA, 201 bp, Homo sapiens
tccttggaacacatctgacactctacgagtgttttaaaattttatttaatctgaaaagaatgaagaaggaatgagttctggtgttctattgcacagtaggmtgacaatagtttacagtaagatttagcaaattacaaaatagctagatgagaggtttttgaatgtcttcaccataaaaaaaaaagataaatggatgaagta

SEQ ID NO: 67662 - DNA, 201 bp, Homo sapiens
aattatattaaagggcttgtttctgtctcttctagagatatgtctgggaaccaaggtacggattggtagtggcttttgcagaatacttgttttccatcctyaggaataggagttgttttcatttagaccttttaggatccaggaaagaagtatattttcattaacatgcttaagaatagtttcactgaattggaagctgag

SEQ ID NO: 67663 - DNA, 201 bp, Homo sapiens
ttatattaaagggcttgtttctgtctcttctagagatatgtctgggaaccaaggtacggattggtagtggcttttgcagaatacttgttttccatcctcargaataggagttgttttcatttagaccttttaggatccaggaaagaagtatattttcattaacatgcttaagaatagtttcactgaattggaagctgagag

SEQ ID NO: 67664 - DNA, 201 bp, Homo sapiens
gaaattaagaccacacaactggtaaagaatcttaaggatctacaggcttcactgcaagaaaaaaaaagaaaaggaataaaaacatcctagtaactttttartaaattcctttactcctcaagttagcaggagagacgtaatacatttcatctctcaacgtagatggctttgataatttacttcaagcaggatcagacattt

SEQ ID NO: 67665 - DNA, 201 bp, Homo sapiens
caggaaagaagtatattttcattaacatgcttaagaatagtttcactgaattggaagctgagagtattatctggccatttggagattcccacatccagtcstctgggataacacagccaaactgtcaagaaacagtacatttactgatatactttggggacaggaggatgaatgcaactaaatggatctcatggagcccct

SEQ ID NO: 67666 - DNA, 201 bp, Homo sapiens
gagattactggattgttgtgaaaagaaactcaaggaagacagtgacacaccaatttgctgttaaaagatatggtaaccagttgctatttgtagctgtcctrtgtagatgaagagtttaaaggatggaccaacacaacatttgtgttagacttaggcaggagtaggtgaagctagaactggttttctttgtctcccttcctt

SEQ ID NO: 67667 - DNA, 201 bp, Homo sapiens
tccaggaaagaagtatattttcattaacatgcttaagaatagtttcactgaattggaagctgagagtattatctggccatttggagattcccacatccagkcctctgggataacacagccaaactgtcaagaaacagtacatttactgatatactttggggacaggaggatgaatgcaactaaatggatctcatggagccc

SEQ ID NO: 67668 - DNA, 201 bp, Homo sapiens
atccgaaactatccgaaatatggcagcaaagggtaatactctcatacaaattctgattgtttatatttttttcattattttctaggatcctcaaaacaatyggatttttcaatggcaaaatgtgacttctttccgaaatattacccaactctcgttccaactgatttcagaaccaatgtttggagattactggattgttgt

SEQ ID NO: 67669 - DNA, 201 bp, Homo sapiens
aatctcttaatgcttttaaactgattgggaaaagaggggaggtgattattttcttttgctttgtcttttaattcatttaatgtgcctgtcatgtcagatgytagaaatacagtgagaataatgcaggtaaatctttatattcgtgaagtttacattgaatttgggatgcagacaatatacaaatggctgcatattgtcatt

SEQ ID NO: 67670 - DNA, 201 bp, Homo sapiens
ttaatcattagtgagacaccaccatgtagaatggtgccacacaatttggggcaaatgatacatagctcatacagatggagggtacaaggaatcatagtaarctatatgactgcaataaggtttgcttgcctgtgattgtgcaggctaacgtatatttctcttcgtttccagtgctgcccaagtttgaagttacggtcaatg

SEQ ID NO: 67671 - DNA, 201 bp, Homo sapiens
ctttatattcgtgaagtttacattgaatttgggatgcagacaatatacaaatggctgcatattgtcatttgtatatttcttgtgttgctgtaaagaaatayttgaggctgggtaatttacaaagaaaataggggccaagtgcggtggctcacacctataatcccagcactttgggaggctgaggcaggcagatcacctgag

SEQ ID NO: 67672 - DNA, 201 bp, Homo sapiens
tgtttctactaaaaatacaaaaaattagccaggcgtggtggtgcatgcctctaatcccagctactcgggaggctgaggcagaagaatcacttgaacccagraggcagaggttgcagtgagccaagattgtgccattgcactccagcttgggcaacaagagtgaaactccttttcaaaaaaaaaaaaaaggaagaaaatagg

SEQ ID NO: 67673 - DNA, 201 bp, Homo sapiens
acacaccaagccctgtgagtcttcaaggcctagctagttcacaaaacatctttaatttgtttactatacaagtactttattgatgtaccagcactcttcamtatcaaaatattgacgcaaaaggtagccctgtcttcatataaaatataattcattatggatcttccagaataaaaatctatcctaaaacagttgctaaat

SEQ ID NO: 67674 - DNA, 201 bp, Homo sapiens
catttactgatatactttggggacaggaggatgaatgcaactaaatggatctcatggagcccctccatgtcccacaatgcagtctttacatttcatggaargagaatgttaccctcccaccacgttcaagtggaaccatctatggatcagattcctcaatttgtgaaattaagaccacacaactggtaaagaatcttaagg

SEQ ID NO: 67675 - DNA, 201 bp, Homo sapiens
gatgtaccagcactcttcactatcaaaatattgacgcaaaaggtagccctgtcttcatataaaatataattcattatggatcttccagaataaaaatctaycctaaaacagttgctaaatgaacttattatgacagcttgtgtgtgtttatttgtgtaaactcaatataacattttggcaaaatatatattgaactatcca

SEQ ID NO: 67676 - DNA, 201 bp, Homo sapiens
tattatgacagcttgtgtgtgtttatttgtgtaaactcaatataacattttggcaaaatatatattgaactatccatcctaaacataatctaatagggctrttttcttcttgagattacttctgcaacaagttagcaaaactatagcagagatggccagttttattagtacatcaaaaaatagacctatcagaataaactt

SEQ ID NO: 67677 - DNA, 201 bp, Homo sapiens
gcagtgagccaagattgcaccactgcactccagcctgggcaacagagtgaaactccgtctcaaacaaacaaacaaaaagaaacaaaatgtgaaattctgargatagggaaaagaaaagaaagaggaagaattaatcattagtgagacaccaccatgtagaatggtgccacacaatttggggcaaatgatacatagctcata

SEQ ID NO: 67678 - DNA, 201 bp, Homo sapiens
acaatttggggcaaatgatacatagctcatacagatggagggtacaaggaatcatagtaagctatatgactgcaataaggtttgcttgcctgtgattgtgsaggctaacgtatatttctcttcgtttccagtgctgcccaagtttgaagttacggtcaatgcaccacaaacagtaactatttcagatgatgaattccaagt

SEQ ID NO: 67679 - DNA, 201 bp, Homo sapiens
acagtaggctgacaatagtttacagtaagatttagcaaattacaaaatagctagatgagaggtttttgaatgtcttcaccataaaaaaaaaagataaatgratgaagtactggtaacactgccccaatatgatcattatactacatatatagatatgtgtgtgtgtctgtgtgtgtgtgtgtgtattgaaacatcaaattg

SEQ ID NO: 67680 - DNA, 201 bp, Homo sapiens
aaaatagctagatgagaggtttttgaatgtcttcaccataaaaaaaaaagataaatggatgaagtactggtaacactgccccaatatgatcattatactamatatatagatatgtgtgtgtgtctgtgtgtgtgtgtgtgtattgaaacatcaaattgtacccccccacttttttttttatttttgagacaaagtctcact

SEQ ID NO: 67681 - DNA, 201 bp, Homo sapiens
aaaatagacctatcagaataaacttttggcctgaattcctcatgttatgtatttaaatatttagactaggactggtcacttctagatgtaattgttccaarggttcatattttttttgacttggcctgggaagagatagaattaaatatacaaggaaaatttaagtaagttttgttaacgtgtaattcaatttgattagaa

SEQ ID NO: 67682 - DNA, 201 bp, Homo sapiens
cctcactaataacatctgagatgagaggcaaagattatgactatcaggaataaccagaatttggggccaaattgtcttcattgtaggtctaacagagaccrgatccatcttctggttatttattcattttccaaatgtgtaggtataattgacaagtctagcaatgatcagaattcccactgtggctcctcgtgtgtggaa

SEQ ID NO: 67683 - DNA, 201 bp, Homo sapiens
atctaaaattgattttatcttgaaaggcaacaggattaaagatttttaccaactctcacctccggaaaccagtattgtgcaaggattctaaccatcttgamtctactgattacatacccttaggtaagtcacagtataatgcgaagggcaggtgacaggttataatctcttaatgcttttaaactgattgggaaaagaggg

SEQ ID NO: 67684 - DNA, 201 bp, Homo sapiens
actgattacatacccttaggtaagtcacagtataatgcgaagggcaggtgacaggttataatctcttaatgcttttaaactgattgggaaaagaggggagrtgattattttcttttgctttgtcttttaattcatttaatgtgcctgtcatgtcagatgttagaaatacagtgagaataatgcaggtaaatctttatattc

SEQ ID NO: 67685 - DNA, 201 bp, Homo sapiens
aacagagaccagatccatcttctggttatttattcattttccaaatgtgtaggtataattgacaagtctagcaatgatcagaattcccactgtggctcctygtgtgtggaataaacacattggagtggatgtgaaaaggttctgcctatcttatcctaaatgaactagaagttgccattatactcacagttccctgaaaat

SEQ ID NO: 67686 - DNA, 201 bp, Homo sapiens
attgacaagtctagcaatgatcagaattcccactgtggctcctcgtgtgtggaataaacacattggagtggatgtgaaaaggttctgcctatcttatcctmaatgaactagaagttgccattatactcacagttccctgaaaataaactcttccatggcctccccatttcactcccttctgattcccagtctcagaacaga

SEQ ID NO: 67687 - DNA, 201 bp, Homo sapiens
gaatagtttcactgaattggaagctgagagtattatctggccatttggagattcccacatccagtcctctgggataacacagccaaactgtcaagaaacartacatttactgatatactttggggacaggaggatgaatgcaactaaatggatctcatggagcccctccatgtcccacaatgcagtctttacatttcatgg

SEQ ID NO: 67688 - DNA, 201 bp, Homo sapiens
acatcaaaaaatagacctatcagaataaacttttggcctgaattcctcatgttatgtatttaaatatttagactaggactggtcacttctagatgtaattsttccaaaggttcatattttttttgacttggcctgggaagagatagaattaaatatacaaggaaaatttaagtaagttttgttaacgtgtaattcaatttg

SEQ ID NO: 67689 - DNA, 201 bp, Homo sapiens
gaacaatatattctatgtaagtaacatggatttagatataaaaattctgcttggctcttctaagattatttctccgagcttctcacatacctaatctccarataagaaggatctaataaaaatgaatgtcaaaaatatgagggcccttcattgcatcacttttgtaacactcaataattcatccaatcaattttgattagg

SEQ ID NO: 67690 - DNA, 201 bp, Homo sapiens
aagaaaattatatgactataataacaaggagcacagtggcttaaaattttaagctaatatgggctgtgaacatgtcatatacatttttgtgccttgagcayttggatcagtccttggaacacatctgacactctacgagtgttttaaaattttatttaatctgaaaagaatgaagaaggaatgagttctggtgttctattg

SEQ ID NO: 67691 - DNA, 201 bp, Homo sapiens
ctgatttcactctgataagaatggatttgcaattcacaattccagcagaaagaacaacctggagctaattatctctaagaatgacagtattacacaccaarccctgtgagtcttcaaggcctagctagttcacaaaacatctttaatttgtttactatacaagtactttattgatgtaccagcactcttcactatcaaaat

SEQ ID NO: 67692 - DNA, 201 bp, Homo sapiens
agaagttgccattatactcacagttccctgaaaataaactcttccatggcctccccatttcactcccttctgattcccagtctcagaacagagcatctcaytggtcgagcctgtcatttacctgccccctggattcaaggtaatctgggaatggagtcttctaacttctttactggaagtgaaacgcatatgttgggaaat

SEQ ID NO: 67693 - DNA, 201 bp, Homo sapiens
ctgccttctttttcccctagaaaatatacattttttctagaatccccacagtcttctaggagagatctaagagattgcaatagaaagaaaatgtgaggccrggtgtggtggctcacgcctgtaatcccagcactttgagagactgaggcgagtggatcatgaggtcaggagttcgagaccagcctcaccaacatggtgaaa

SEQ ID NO: 67694 - DNA, 201 bp, Homo sapiens
cagtcttctaggagagatctaagagattgcaatagaaagaaaatgtgaggccaggtgtggtggctcacgcctgtaatcccagcactttgagagactgaggygagtggatcatgaggtcaggagttcgagaccagcctcaccaacatggtgaaacccagtctctactaaaaatacaaaaattagcccagcgtggtcgtgcat

SEQ ID NO: 67695 - DNA, 201 bp, Homo sapiens
attgcaatagaaagaaaatgtgaggccaggtgtggtggctcacgcctgtaatcccagcactttgagagactgaggcgagtggatcatgaggtcaggagttsgagaccagcctcaccaacatggtgaaacccagtctctactaaaaatacaaaaattagcccagcgtggtcgtgcatgcctgtaatcccagctactcgggag

SEQ ID NO: 67696 - DNA, 201 bp, Homo sapiens
cttctaagattatttctccgagcttctcacatacctaatctccagataagaaggatctaataaaaatgaatgtcaaaaatatgagggcccttcattgcatmacttttgtaacactcaataattcatccaatcaattttgattagggttgaagttctgatttcactctgataagaatggatttgcaattcacaattccagca

SEQ ID NO: 67697 - DNA, 201 bp, Homo sapiens
cccagtctctactaaaaatacaaaaattagcccagcgtggtcgtgcatgcctgtaatcccagctactcgggaggctgaggcaggagaatggcttgaacccygtaggcagaggttgcagtgagccaagattgcaccactgcactccagcctgggcaacagagtgaaactccgtctcaaacaaacaaacaaaaagaaacaaaa

SEQ ID NO: 67698 - DNA, 201 bp, Homo sapiens
ttacaggtgtgagccactgtgccccgccaattgtatcctttaagtatgtacaattacaatactttaaaaaaagaaaaaagaataaaggcagtacaagtttktatgaccaaagcatagtgtataatcctctaagatttatagacattagggttcttaagccctcacaggctctaccaaaagctacttgtttgtttcataaga

SEQ ID NO: 67699 - DNA, 201 bp, Homo sapiens
tggcttaaaattttaagctaatatgggctgtgaacatgtcatatacatttttgtgccttgagcatttggatcagtccttggaacacatctgacactctacragtgttttaaaattttatttaatctgaaaagaatgaagaaggaatgagttctggtgttctattgcacagtaggctgacaatagtttacagtaagatttag

SEQ ID NO: 67700 - DNA, 201 bp, Homo sapiens
aaatgtgacttctttccgaaatattacccaactctcgttccaactgatttcagaaccaatgtttggagattactggattgttgtgaaaagaaactcaaggragacagtgacacaccaatttgctgttaaaagatatggtaaccagttgctatttgtagctgtcctgtgtagatgaagagtttaaaggatggaccaacacaa

SEQ ID NO: 67701 - DNA, 201 bp, Homo sapiens
agcctcccaagtagctgggattacagaggcacacgccaccatacccaactaatttttgtatttttagtagagatggggtttcacaatattacccaagctgrtcttgaactccttggctctagtgatctgcccaccttggcatcccaaagtgctaggattacaggtgtgagccactgtgccccgccaattgtatcctttaag

SEQ ID NO: 67702 - DNA, 201 bp, Homo sapiens
ttaaaggatggaccaacacaacatttgtgttagacttaggcaggagtaggtgaagctagaactggttttctttgtctcccttccttgacctggttggcttygtcatcagcactttgctgctcctctctccttccccagtatccttattctgattcctgccttctttttcccctagaaaatatacattttttctagaatccc

SEQ ID NO: 67703 - DNA, 201 bp, Homo sapiens
gctgggattacagaggcacacgccaccatacccaactaatttttgtatttttagtagagatggggtttcacaatattacccaagctggtcttgaactcctkggctctagtgatctgcccaccttggcatcccaaagtgctaggattacaggtgtgagccactgtgccccgccaattgtatcctttaagtatgtacaattac

SEQ ID NO: 67704 - DNA, 201 bp, Homo sapiens
ccgaaatatggcagcaaagggtaatactctcatacaaattctgattgtttatatttttttcattattttctaggatcctcaaaacaatcggatttttcaawggcaaaatgtgacttctttccgaaatattacccaactctcgttccaactgatttcagaaccaatgtttggagattactggattgttgtgaaaagaaactc

SEQ ID NO: 67705 - DNA, 201 bp, Homo sapiens
gtgacacaccaatttgctgttaaaagatatggtaaccagttgctatttgtagctgtcctgtgtagatgaagagtttaaaggatggaccaacacaacatttrtgttagacttaggcaggagtaggtgaagctagaactggttttctttgtctcccttccttgacctggttggcttcgtcatcagcactttgctgctcctctc

SEQ ID NO: 67706 - DNA, 201 bp, Homo sapiens
catagtaagctatatgactgcaataaggtttgcttgcctgtgattgtgcaggctaacgtatatttctcttcgtttccagtgctgcccaagtttgaagttayggtcaatgcaccacaaacagtaactatttcagatgatgaattccaagtggatgtatgtgctaagtgagtatttattcagagatttaccttcacaagaaaa

SEQ ID NO: 67707 - DNA, 201 bp, Homo sapiens
tgattattttcttttgctttgtcttttaattcatttaatgtgcctgtcatgtcagatgttagaaatacagtgagaataatgcaggtaaatctttatattcrtgaagtttacattgaatttgggatgcagacaatatacaaatggctgcatattgtcatttgtatatttcttgtgttgctgtaaagaaatacttgaggctgg

SEQ ID NO: 67708 - DNA, 201 bp, Homo sapiens
gggctgtgaacatgtcatatacatttttgtgccttgagcatttggatcagtccttggaacacatctgacactctacgagtgttttaaaattttatttaatytgaaaagaatgaagaaggaatgagttctggtgttctattgcacagtaggctgacaatagtttacagtaagatttagcaaattacaaaatagctagatgag

SEQ ID NO: 67709 - DNA, 201 bp, Homo sapiens
ctgaattttcatgccttgatatttatataattttcactggagtccacttcagttaggcagacacccatccctaaggtctcacttctatctttctcaaagayattctgcctcattaccaaagcacatgagctcctggaaagataaatatctaaatattctataaaatactgaatattacctcactaataacatctgagatga

SEQ ID NO: 67710 - DNA, 201 bp, Homo sapiens; identical to SEQ ID NO: 67390

SEQ ID NO: 67711 - DNA, 201 bp, Homo sapiens; identical to SEQ ID NO: 67391

SEQ ID NO: 67712 - DNA, 201 bp, Homo sapiens; identical to SEQ ID NO: 67392
  misc_feature (1)...(201): n = A,T,C or G, or insertion/deletion polymorphism (see Tables 1-2)

SEQ ID NO: 67713 - DNA, 201 bp, Homo sapiens; identical to SEQ ID NO: 67393

SEQ ID NO: 67714 - DNA, 201 bp, Homo sapiens; identical to SEQ ID NO: 67394

SEQ ID NO: 67715 - DNA, 201 bp, Homo sapiens; identical to SEQ ID NO: 67395

SEQ ID NO: 67716 - DNA, 201 bp, Homo sapiens; identical to SEQ ID NO: 67396

SEQ ID NO: 67717 - DNA, 201 bp, Homo sapiens; identical to SEQ ID NO: 67397

SEQ ID NO: 67718 - DNA, 201 bp, Homo sapiens; identical to SEQ ID NO: 67398

SEQ ID NO: 67719 - DNA, 201 bp, Homo sapiens; identical to SEQ ID NO: 67399

SEQ ID NO: 67720 - DNA, 201 bp, Homo sapiens; identical to SEQ ID NO: 67400

SEQ ID NO: 67721 - DNA, 201 bp, Homo sapiens; identical to SEQ ID NO: 67401

SEQ ID NO: 67722 - DNA, 201 bp, Homo sapiens; identical to SEQ ID NO: 67402

SEQ ID NO: 67723 - DNA, 201 bp, Homo sapiens; identical to SEQ ID NO: 67403

SEQ ID NO: 67724 - DNA, 201 bp, Homo sapiens; identical to SEQ ID NO: 67404
  misc_feature (1)...(201): n = A,T,C or G, or insertion/deletion polymorphism (see Tables 1-2)

SEQ ID NO: 67725 - DNA, 201 bp, Homo sapiens; identical to SEQ ID NO: 67405

SEQ ID NO: 67726 - DNA, 201 bp, Homo sapiens; identical to SEQ ID NO: 67406
  misc_feature (1)...(201): n = A,T,C or G, or insertion/deletion polymorphism (see Tables 1-2)

SEQ ID NO: 67727 - DNA, 201 bp, Homo sapiens; identical to SEQ ID NO: 67407

SEQ ID NO: 67728 - DNA, 201 bp, Homo sapiens; identical to SEQ ID NO: 67408
  misc_feature (1)...(201): n = A,T,C or G, or insertion/deletion polymorphism (see Tables 1-2)

SEQ ID NO: 67729 - DNA, 201 bp, Homo sapiens; identical to SEQ ID NO: 67409

SEQ ID NO: 67730 - DNA, 201 bp, Homo sapiens; identical to SEQ ID NO: 67410

SEQ ID NO: 67731 - DNA, 201 bp, Homo sapiens; identical to SEQ ID NO: 67411

SEQ ID NO: 67732 - DNA, 201 bp, Homo sapiens; identical to SEQ ID NO: 67412

SEQ ID NO: 67733 - DNA, 201 bp, Homo sapiens; identical to SEQ ID NO: 67413

SEQ ID NO: 67734 - DNA, 201 bp, Homo sapiens; identical to SEQ ID NO: 67414

SEQ ID NO: 67735 - DNA, 201 bp, Homo sapiens; identical to SEQ ID NO: 67415

SEQ ID NO: 67736 - DNA, 201 bp, Homo sapiens; identical to SEQ ID NO: 67416

SEQ ID NO: 67737 - DNA, 201 bp, Homo sapiens; identical to SEQ ID NO: 67417

SEQ ID NO: 67738 - DNA, 201 bp, Homo sapiens; identical to SEQ ID NO: 67418

SEQ ID NO: 67739 - DNA, 201 bp, Homo sapiens; identical to SEQ ID NO: 67419

SEQ ID NO: 67740 - DNA, 201 bp, Homo sapiens; identical to SEQ ID NO: 67420

SEQ ID NO: 67741 - DNA, 201 bp, Homo sapiens; identical to SEQ ID NO: 67421

SEQ ID NO: 67742 - DNA, 201 bp, Homo sapiens; identical to SEQ ID NO: 67422

SEQ ID NO: 67743 - DNA, 201 bp, Homo sapiens; identical to SEQ ID NO: 67423

SEQ ID NO: 67744 - DNA, 201 bp, Homo sapiens; identical to SEQ ID NO: 67424

SEQ ID NO: 67745 - DNA, 201 bp, Homo sapiens; identical to SEQ ID NO: 67425

SEQ ID NO: 67746 - DNA, 201 bp, Homo sapiens; identical to SEQ ID NO: 67426

SEQ ID NO: 67747 - DNA, 201 bp, Homo sapiens; identical to SEQ ID NO: 67427

SEQ ID NO: 67748 - DNA, 201 bp, Homo sapiens
ggtgttaagaatttggctagtgggagaatcaaatggaatgtcgtggaaagtaaactgcgctggaggaatgttaaaccagtataaggctgaaggaaggaagrcttccaaggacaatggattagatgcccaaaacacgtcaaggaagaagtggaataagaataattaaggggaacagctgaaagtagaatgtgatgtattaaa

SEQ ID NO: 67749 - DNA, 201 bp, Homo sapiens
aaaacagaaaaatgtgtgtggcaggtgttaagaatttggctagtgggagaatcaaatggaatgtcgtggaaagtaaactgcgctggaggaatgttaaaccrgtataaggctgaaggaaggaaggcttccaaggacaatggattagatgcccaaaacacgtcaaggaagaagtggaataagaataattaaggggaacagctg

SEQ ID NO: 67750 - DNA, 201 bp, Homo sapiens
agaacagttattaaggtcttttaagatatggtaagaattttggattgagaagtgactaatggttttaagaaagagagtaacatgatcaggttagctcaggmtgtatagaatggtttagacaagaatgaagcagcaaggaaatgcagaagattaaatagctactggaaaccagatgggaaaaaatgtgattttaactagaat

SEQ ID NO: 67751 - DNA, 201 bp, Homo sapiens
gaagagaggggagaagccaaaggttgataatgaataaatcaatgatgaacgaagaaactttatgtcattcttgggcttgggaaaagataagcaccaaaagratggtcagaacatttgttacatttatttttatggccagtaaaaaaattctcataaattgacagctgactttttaagtagcaaattggaagacctgagaat

SEQ ID NO: 67752 - DNA, 201 bp, Homo sapiens
atagatggaagacccatatactgaaagagagaacagtggaagtggagaaagtttgggaaggtagtgtgatgatcccacttttggatgttctcaatttgagkccccatgagatatccaaatagaactattcaagattttgagatgtattgcataacaggataattatagtcagtaataatatattgtacatttcaaaataat

SEQ ID NO: 67753 - DNA, 201 bp, Homo sapiens
ggggagaggagatagcacttgacaatgagtttgagataagcagtgaaagaaaatgactcattaaaaaaaacccaattcctcagtattcctgcgtcagttayctgatagatggaagacccatatactgaaagagagaacagtggaagtggagaaagtttgggaaggtagtgtgatgatcccacttttggatgttctcaattt

SEQ ID NO: 67754 - DNA, 201 bp, Homo sapiens
gtgtcgccacggcaatggtaaactgacatggcacactggtaggcacgtctaatggaaagcagccaccctgcatccctgttttagtaagttctcaatttggyccggtgtctgagacctgcttccaaagttgagtcccacctcttacctcaagggtatggaaaagaaagttatcaaagctgcagagagcaaatgaatgagagg

SEQ ID NO: 67755 - DNA, 201 bp, Homo sapiens
aggtgttagagacagcaacgtttattgaagcagcagcgtacagcagcagcagaggtactgttccttgcagagcagggctaccccataagcagtgtgcccayagtagcagctcaaagggagtactgcagtcatatttacacccattttagttacatggaaattaagaggcagattatgcagaaatttccaggaaaaagtggt

SEQ ID NO: 67756 - DNA, 201 bp, Homo sapiens
tggtctggtgacacttagtgtatgcagaagatattcactatgccgttccgactgccacaacacacattcacaaagtatctgtgaagaattcaatcaacagktatgtggaaaccactctcctcaggacactaataccaaggttttctcttctcatggattacaatagtgaatacaatacaacagagaatagtgtttgaaata

SEQ ID NO: 67757 - DNA, 201 bp, Homo sapiens
aaggcaaaaattactgattccagaggcagagtatgtaaaaagtccagggtgtggcagtatgagcagaccctgtaagggtgacgcagggcaggtaagctccsaaatggggttttagcccaagagggttcttttcttcacccaggaaagaattcaagggcaagccagaggtgttagagacagcaacgtttattgaagcagcag

SEQ ID NO: 67758 - DNA, 201 bp, Homo sapiens
tgtatgcagaagatattcactatgccgttccgactgccacaacacacattcacaaagtatctgtgaagaattcaatcaacaggtatgtggaaaccactctsctcaggacactaataccaaggttttctcttctcatggattacaatagtgaatacaatacaacagagaatagtgtttgaaatacccatcaagcaaaatggt

SEQ ID NO: 67759 - DNA, 201 bp, Homo sapiens
tcatgtgaatactagatactatttcagtgcaactactgatgagcatggtttggtgaacatttccatggacaccaccaactacatatcaccttttctcacartttcagtaagtggaaaggggcatctgggaccaaaaatagagaaattactgtggccagagataatttaaagatatttgagaggcatgtgaactctaggaat

SEQ ID NO: 67760 - DNA, 201 bp, Homo sapiens
tgcagccatagcgtgttaagagaaagtaattgaccttgtttgtgaatgaataacatctactaaatcagtacagcataagcttaaatgatctcgaggggaakcagtttacagattctgctatatttaagaaagcagccttcttatatggctttattatattgctttatgtatatatatacaaacatatataatatgcatatt

SEQ ID NO: 67761 - DNA, 201 bp, Homo sapiens
atatttacacccattttagttacatggaaattaagaggcagattatgcagaaatttccaggaaaaagtggtaacttctgggttgtcaggccattgccatgraaagaggcattaacttcgggtgtcgccacggcaatggtaaactgacatggcacactggtaggcacgtctaatggaaagcagccaccctgcatccctgttt

SEQ ID NO: 67762 - DNA, 201 bp, Homo sapiens
atgtacaatgaagtctgagatgagaattcgatatggagggcaagtagggaatcttttaagaatttgatagcactgtgtttttgataagaacaagatacagrgtacacatcattgaatggaaaagcaccaggtgttcactatcctttggatagctcacgcagggaaacgacaggtctttctggaaataaagtttgtattaga

SEQ ID NO: 67763 - DNA, 201 bp, Homo sapiens
atatttaagaaagcagccttcttatatggctttattatattgctttatgtatatatatacaaacatatataatatgcatatttttatatatttttgcaatyatatatatattatatataaaacagcttatttattcttccattaggtcaaatacaaagagagtaacaattgttctgataactggtggcttgatgaatttca

SEQ ID NO: 67764 - DNA, 201 bp, Homo sapiens
gagagcagggatgtgagagagggaaaaacaaagatggagcaagatcacagaggagttgagaaaataaagaacataggtggaaaaccagaggaatgagggaygatggataccaataatgtttcatgtgaaggtgaagctaatgtccagttgctggtcaaatagcttgtaaatgtgggaaactggcaagaataaagaaaagag

SEQ ID NO: 67765 - DNA, 201 bp, Homo sapiens
ttaagaggcagattatgcagaaatttccaggaaaaagtggtaacttctgggttgtcaggccattgccatggaaagaggcattaacttcgggtgtcgccacrgcaatggtaaactgacatggcacactggtaggcacgtctaatggaaagcagccaccctgcatccctgttttagtaagttctcaatttggtccggtgtctg

SEQ ID NO: 67766 - DNA, 201 bp, Homo sapiens; identical to SEQ ID NO: 44160

SEQ ID NO: 67767 - DNA, 201 bp, Homo sapiens; identical to SEQ ID NO: 44161

SEQ ID NO: 67768 - DNA, 201 bp, Homo sapiens; identical to SEQ ID NO: 43957

SEQ ID NO: 67769 - DNA, 201 bp, Homo sapiens; identical to SEQ ID NO: 44162

SEQ ID NO: 67770 - DNA, 201 bp, Homo sapiens; identical to SEQ ID NO: 44163

SEQ ID NO: 67771 - DNA, 201 bp, Homo sapiens; identical to SEQ ID NO: 44164

SEQ ID NO: 67772 - DNA, 201 bp, Homo sapiens; identical to SEQ ID NO: 44165

SEQ ID NO: 67773 - DNA, 201 bp, Homo sapiens; identical to SEQ ID NO: 44251

SEQ ID NO: 67774 - DNA, 201 bp, Homo sapiens; identical to SEQ ID NO: 43878

SEQ ID NO: 67775 - DNA, 201 bp, Homo sapiens; identical to SEQ ID NO: 44256

SEQ ID NO: 67776 - DNA, 201 bp, Homo sapiens; identical to SEQ ID NO: 44260

SEQ ID NO: 67777 - DNA, 201 bp, Homo sapiens; identical to SEQ ID NO: 44263

SEQ ID NO: 67778 - DNA, 201 bp, Homo sapiens; identical to SEQ ID NO: 44265

SEQ ID NO: 67779 - DNA, 201 bp, Homo sapiens; identical to SEQ ID NO: 44267

SEQ ID NO: 67780 - DNA, 201 bp, Homo sapiens; identical to SEQ ID NO: 43880

SEQ ID NO: 67781 - DNA, 201 bp, Homo sapiens; identical to SEQ ID NO: 43879

SEQ ID NO: 67782 - DNA, 201 bp, Homo sapiens; identical to SEQ ID NO: 44269

SEQ ID NO: 67783 - DNA, 201 bp, Homo sapiens; identical to SEQ ID NO: 43881

SEQ ID NO: 67784 - DNA, 201 bp, Homo sapiens; identical to SEQ ID NO: 44271

SEQ ID NO: 67785 - DNA, 201 bp, Homo sapiens; identical to SEQ ID NO: 43882

SEQ ID NO: 67786 - DNA, 201 bp, Homo sapiens; identical to SEQ ID NO: 44272

SEQ ID NO: 67787 - DNA, 201 bp, Homo sapiens; identical to SEQ ID NO: 44273

SEQ ID NO: 67788 - DNA, 201 bp, Homo sapiens; identical to SEQ ID NO: 43961

SEQ ID NO: 67789 - DNA, 201 bp, Homo sapiens; identical to SEQ ID NO: 43965

SEQ ID NO: 67790 - DNA, 201 bp, Homo sapiens; identical to SEQ ID NO: 43970

SEQ ID NO: 67791 - DNA, 201 bp, Homo sapiens; identical to SEQ ID NO: 43972

SEQ ID NO: 67792 - DNA, 201 bp, Homo sapiens; identical to SEQ ID NO: 43975

SEQ ID NO: 67793 - DNA, 201 bp, Homo sapiens; identical to SEQ ID NO: 44336

SEQ ID NO: 67794 - DNA, 201 bp, Homo sapiens; identical to SEQ ID NO: 43978

SEQ ID NO: 67795 - DNA, 201 bp, Homo sapiens; identical to SEQ ID NO: 44338

SEQ ID NO: 67796 - DNA, 201 bp, Homo sapiens; identical to SEQ ID NO: 43981

SEQ ID NO: 67797 - DNA, 201 bp, Homo sapiens; identical to SEQ ID NO: 44177

SEQ ID NO: 67798 - DNA, 201 bp, Homo sapiens; identical to SEQ ID NO: 44340

SEQ ID NO: 67799 - DNA, 201 bp, Homo sapiens; identical to SEQ ID NO: 43984

SEQ ID NO: 67800 - DNA, 201 bp, Homo sapiens; identical to SEQ ID NO: 44180

SEQ ID NO: 67801 - DNA, 201 bp, Homo sapiens; identical to SEQ ID NO: 44342

SEQ ID NO: 67802 - DNA, 201 bp, Homo sapiens; identical to SEQ ID NO: 43805

SEQ ID NO: 67803 - DNA, 201 bp, Homo sapiens; identical to SEQ ID NO: 43986

SEQ ID NO: 67804 - DNA, 201 bp, Homo sapiens; identical to SEQ ID NO: 44184

SEQ ID NO: 67805 - DNA, 201 bp, Homo sapiens; identical to SEQ ID NO: 43806

SEQ ID NO: 67806 - DNA, 201 bp, Homo sapiens; identical to SEQ ID NO: 43987

SEQ ID NO: 67807 - DNA, 201 bp, Homo sapiens; identical to SEQ ID NO: 44186

SEQ ID NO: 67808 - DNA, 201 bp, Homo sapiens; identical to SEQ ID NO: 43988

SEQ ID NO: 67809 - DNA, 201 bp, Homo sapiens; identical to SEQ ID NO: 43807

SEQ ID NO: 67810 - DNA, 201 bp, Homo sapiens; identical to SEQ ID NO: 44187

SEQ ID NO: 67811 - DNA, 201 bp, Homo sapiens; identical to SEQ ID NO: 43894

SEQ ID NO: 67812 - DNA, 201 bp, Homo sapiens; identical to SEQ ID NO: 43811

SEQ ID NO: 67813 - DNA, 201 bp, Homo sapiens; identical to SEQ ID NO: 43812

SEQ ID NO: 67814 - DNA, 201 bp, Homo sapiens; identical to SEQ ID NO: 43813

SEQ ID NO: 67815 - DNA, 201 bp, Homo sapiens; identical to SEQ ID NO: 43814

SEQ ID NO: 67816 - DNA, 201 bp, Homo sapiens; identical to SEQ ID NO: 43815

SEQ ID NO: 67817 - DNA, 201 bp, Homo sapiens; identical to SEQ ID NO: 43816

SEQ ID NO: 67818 - DNA, 201 bp, Homo sapiens; identical to SEQ ID NO: 44123

SEQ ID NO: 67819 - DNA, 201 bp, Homo sapiens; identical to SEQ ID NO: 44126

SEQ ID NO: 67820 - DNA, 201 bp, Homo sapiens; identical to SEQ ID NO: 44127

SEQ ID NO: 67821 - DNA, 201 bp, Homo sapiens; identical to SEQ ID NO: 44128

SEQ ID NO: 67822 - DNA, 201 bp, Homo sapiens; identical to SEQ ID NO: 44129

SEQ ID NO: 67823 - DNA, 201 bp, Homo sapiens; identical to SEQ ID NO: 44130

SEQ ID NO: 67824 - DNA, 201 bp, Homo sapiens; identical to SEQ ID NO: 44131

SEQ ID NO: 67825 - DNA, 201 bp, Homo sapiens; identical to SEQ ID NO: 44132

SEQ ID NO: 67826 - DNA, 201 bp, Homo sapiens; identical to SEQ ID NO: 44079

SEQ ID NO: 67827 - DNA, 201 bp, Homo sapiens; identical to SEQ ID NO: 44133

SEQ ID NO: 67828 - DNA, 201 bp, Homo sapiens; identical to SEQ ID NO: 44080

SEQ ID NO: 67829 - DNA, 201 bp, Homo sapiens; identical to SEQ ID NO: 44202

SEQ ID NO: 67830 - DNA, 201 bp, Homo sapiens; identical to SEQ ID NO: 44134

SEQ ID NO: 67831 - DNA, 201 bp, Homo sapiens; identical to SEQ ID NO: 44204

SEQ ID NO: 67832 - DNA, 201 bp, Homo sapiens; identical to SEQ ID NO: 43823

SEQ ID NO: 67833 - DNA, 201 bp, Homo sapiens; identical to SEQ ID NO: 44206

SEQ ID NO: 67834 - DNA, 201 bp, Homo sapiens; identical to SEQ ID NO: 44208

SEQ ID NO: 67835 - DNA, 201 bp, Homo sapiens; identical to SEQ ID NO: 43825

SEQ ID NO: 67836 - DNA, 201 bp, Homo sapiens; identical to SEQ ID NO: 44210

SEQ ID NO: 67837 - DNA, 201 bp, Homo sapiens; identical to SEQ ID NO: 43826

SEQ ID NO: 67838 - DNA, 201 bp, Homo sapiens; identical to SEQ ID NO: 43827

SEQ ID NO: 67839 - DNA, 201 bp, Homo sapiens; identical to SEQ ID NO: 43828

SEQ ID NO: 67840 - DNA, 201 bp, Homo sapiens; identical to SEQ ID NO: 44214

SEQ ID NO: 67841 - DNA, 201 bp, Homo sapiens; identical to SEQ ID NO: 43829

SEQ ID NO: 67842 - DNA, 201 bp, Homo sapiens; identical to SEQ ID NO: 44216

SEQ ID NO: 67843 - DNA, 201 bp, Homo sapiens; identical to SEQ ID NO: 43830

SEQ ID NO: 67844 - DNA, 201 bp, Homo sapiens; identical to SEQ ID NO: 43831

SEQ ID NO: 67845 - DNA, 201 bp, Homo sapiens; identical to SEQ ID NO: 43833

SEQ ID NO: 67846 - DNA, 201 bp, Homo sapiens; identical to SEQ ID NO: 43838

SEQ ID NO: 67847 - DNA, 201 bp, Homo sapiens; identical to SEQ ID NO: 43840

SEQ ID NO: 67848 - DNA, 201 bp, Homo sapiens; identical to SEQ ID NO: 43915

SEQ ID NO: 67849 - DNA, 201 bp, Homo sapiens; identical to SEQ ID NO: 43843

SEQ ID NO: 67850 - DNA, 201 bp, Homo sapiens; identical to SEQ ID NO: 43923

SEQ ID NO: 67851 - DNA, 201 bp, Homo sapiens; identical to SEQ ID NO: 43926

SEQ ID NO: 67852 - DNA, 201 bp, Homo sapiens; identical to SEQ ID NO: 44140

SEQ ID NO: 67853 - DNA, 201 bp, Homo sapiens; identical to SEQ ID NO: 44142

SEQ ID NO: 67854 - DNA, 201 bp, Homo sapiens; identical to SEQ ID NO: 44143

SEQ ID NO: 67855 - DNA, 201 bp, Homo sapiens; identical to SEQ ID NO: 44144

SEQ ID NO: 67856 - DNA, 201 bp, Homo sapiens; identical to SEQ ID NO: 44218

SEQ ID NO: 67857 - DNA, 201 bp, Homo sapiens; identical to SEQ ID NO: 44145

SEQ ID NO: 67858 - DNA, 201 bp, Homo sapiens; identical to SEQ ID NO: 44221

SEQ ID NO: 67859 - DNA, 201 bp, Homo sapiens; identical to SEQ ID NO: 44360

SEQ ID NO: 67860 - DNA, 201 bp, Homo sapiens; identical to SEQ ID NO: 44146

SEQ ID NO: 67861 - DNA, 201 bp, Homo sapiens; identical to SEQ ID NO: 44361

SEQ ID NO: 67862 - DNA, 201 bp, Homo sapiens; identical to SEQ ID NO: 44222

SEQ ID NO: 67863 - DNA, 201 bp, Homo sapiens; identical to SEQ ID NO: 44147

SEQ ID NO: 67864 - DNA, 201 bp, Homo sapiens; identical to SEQ ID NO: 44224

SEQ ID NO: 67865 - DNA, 201 bp, Homo sapiens; identical to SEQ ID NO: 44226

SEQ ID NO: 67866 - DNA, 201 bp, Homo sapiens; identical to SEQ ID NO: 44230

SEQ ID NO: 67867 - DNA, 201 bp, Homo sapiens; identical to SEQ ID NO: 44232

SEQ ID NO: 67868 - DNA, 201 bp, Homo sapiens; identical to SEQ ID NO: 44234

SEQ ID NO: 67869 - DNA, 201 bp, Homo sapiens; identical to SEQ ID NO: 44235

SEQ ID NO: 67870 - DNA, 201 bp, Homo sapiens; identical to SEQ ID NO: 43856

SEQ ID NO: 67871 - DNA, 201 bp, Homo sapiens; identical to SEQ ID NO: 43857

SEQ ID NO: 67872 - DNA, 201 bp, Homo sapiens; identical to SEQ ID NO: 43858

SEQ ID NO: 67873 - DNA, 201 bp, Homo sapiens; identical to SEQ ID NO: 43859

SEQ ID NO: 67874 - DNA, 201 bp, Homo sapiens; identical to SEQ ID NO: 43861

SEQ ID NO: 67875 - DNA, 201 bp, Homo sapiens; identical to SEQ ID NO: 43860

SEQ ID NO: 67876 - DNA, 201 bp, Homo sapiens; identical to SEQ ID NO: 44237

SEQ ID NO: 67877 - DNA, 201 bp, Homo sapiens; identical to SEQ ID NO: 44238

SEQ ID NO: 67878 - DNA, 201 bp, Homo sapiens; identical to SEQ ID NO: 43939

SEQ ID NO: 67879 - DNA, 201 bp, Homo sapiens; identical to SEQ ID NO: 43945

SEQ ID NO: 67880 - DNA, 201 bp, Homo sapiens; identical to SEQ ID NO: 44050

SEQ ID NO: 67881 - DNA, 201 bp, Homo sapiens; identical to SEQ ID NO: 44365

SEQ ID NO: 67882 - DNA, 201 bp, Homo sapiens; identical to SEQ ID NO: 44156

SEQ ID NO: 67883 - DNA, 201 bp, Homo sapiens; identical to SEQ ID NO: 44052

SEQ ID NO: 67884 - DNA, 201 bp, Homo sapiens; identical to SEQ ID NO: 44157

SEQ ID NO: 67885 - DNA, 201 bp, Homo sapiens; identical to SEQ ID NO: 44054

SEQ ID NO: 67886 - DNA, 201 bp, Homo sapiens; identical to SEQ ID NO: 44159

SEQ ID NO: 67887 - DNA, 201 bp, Homo sapiens
gggctgacgggcacctcctcgatgtctcccaccagccgccgccgttgtggtgccctgcctgtcctccgtggtcgctggctatggtgagcccccttccctcrgccgaagccacctgagcgggagaagggcagtggtgcctgactgtgcctcttcccacaggctcaccagggcagaagggcacggtcatgggtacactgcgca

SEQ ID NO: 67888 - DNA, 201 bp, Homo sapiens
tgggcctggggctgctgctctactcctttggtgagtggccctgccctggcaggggatccgatgggcagcaggggctgggtgatgcaccctcccctgggctracgggcacctcctcgatgtctcccaccagccgccgccgttgtggtgccctgcctgtcctccgtggtcgctggctatggtgagcccccttccctcggccga

SEQ ID NO: 67889 - DNA, 201 bp, Homo sapiens
ctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttt

SEQ ID NO: 67890 - DNA, 201 bp, Homo sapiens
tttgccaccgccatcgggatgccagtggagaagaggtacaacagtgtcctgttcggaggtatggctggctctgtgcccttggcgggctctctacggtcctwtgtttggtggacgtggtccagcccaggcccctccccaattctcggtccttgccttcccactccctgggctggcatgtctggtgcccttgcccacatgtcc

SEQ ID NO: 67891 - DNA, 201 bp, Homo sapiens
gggcatcagcaaagggaacgtcagcctctccacggccatcgttgctgacctgggctcgcctctggcccgcagtcaaggcatggtaagtgcacaggctgggyctttggggtcctggtggtgacttctgggcctgggtctccctgtgcagctcgggtggtcttttccctaggcggtcattggggtggccttctcactgggctt

SEQ ID NO: 67892 - DNA, 201 bp, Homo sapiens
tcccacaggctcaccagggcagaagggcacggtcatgggtacactgcgcagcctaggtgctctggccagggccgcggggcccctggtggccgcttcaggtragggcgcgggatggtgctggggcaggctgggggccaagcacctgccctcgcctcccaagtgccagccccctcggggactgggtgacgccaccgtctctcc

SEQ ID NO: 67893 - DNA, 201 bp, Homo sapiens
tctccgcagtgtactggctggccggggcccaggcctgcttcaccacgtggtccgggctctttttgctccccttcttcctcctgcagaagctgagttacccrgcacagacgctcaaggctgagtagctgagccactgtgcccaggctgtgggcaccaggcagagtgggagcctaggtcaggcccctgcccactgcctgaccc

SEQ ID NO: 67894 - DNA, 201 bp, Homo sapiens
cggggctggacattggccttgagggccccaagaccacagctcatggtgccaggcagccccatgatggtgacatctgtctctcaggtctcattggctcggcmttctctgtcctgcagtttctgtgtgcgccactcactggggccacctctgactgcttggggaggcgcccggtgatgctgctgtgcctggtatgttcctggg

SEQ ID NO: 67895 - DNA, 201 bp, Homo sapiens
tgccagagacgctgcccctggagaaacgggtagggctgtggtctgggacccacaggcctaggggctggaggcttgattccatagcgatgtaaagtgccccygtgtgccagccccagatgccagggaggctgggccgctctcttggtgttgggacccttgaggccacagtccgtgggttgccaggccagcagccgctcctgc

SEQ ID NO: 67896 - DNA, 201 bp, Homo sapiens
atggcaccctggtttgccctgctcttcgcagcctccgacctgctgttcatcttctgcttcctgccagagacgctgcccctggagaaacgggtagggctgtrgtctgggacccacaggcctaggggctggaggcttgattccatagcgatgtaaagtgcccctgtgtgccagccccagatgccagggaggctgggccgctct

SEQ ID NO: 67897 - DNA, 201 bp, Homo sapiens
tttttcctcatcggcctcaccatggccaccatccagggtgcctatgcccggcggatccaccctggcggggaagttgctgccgtgaagcgggtagggggctycctccaaagcgggtggcaggcagtcccctgagtcctgcagggcacgggctgtgctgaggctgccgtgcccacctgcaggccctcctgctgctggtgcccg

SEQ ID NO: 67898 - DNA, 201 bp, Homo sapiens
ggacccaccctctggagacagtaaggactcgaccaacccaagcgtggagcctgctctcccctgggcttccccgggcggcgcccttccctgctgtggtcgcyttctcagcacgcgccacctctccccagggctcagcagcctgcgccgcctgggcctagtctacttcctctacctcttcctgttctcgggcctggagtacac

SEQ ID NO: 67899 - DNA, 201 bp, Homo sapiens
tcagggaagcaacccccatccccaggaagccttggcagccactctcgccctggccctgccctgggtggccctgccccgggtgccctgcactaacacacccrctcccagcctacagcaggggaagatgtttttcctcatcggcctcaccatggccaccatccagggtgcctatgcccggcggatccaccctggcggggaagt

SEQ ID NO: 67900 - DNA, 201 bp, Homo sapiens
ggggggcttaaatgttggggaaggggtggaacctgttttcccacgcatgcgcactgcttcccctggccgcaggccgcccccctgcccctctgctgcgcacyccctagggtcgcctcgccaagccgttgccttggagaccgaggttagcctgaatctctgcaggggcctcgcgccgaaggctggggtgggagagcgcatgcg

SEQ ID NO: 67901 - DNA, 201 bp, Homo sapiens
tccatgtttcataaccggcacctcttcaaggacaaggtggtgctggacgtcggctcgggcaccggcatcctctgcatgtttgctgccaaggccggggcccrcaaggtcatcggggtgagtctccagggtggccaggcggggccgggcctgagggatggaggggagcccatcagggctcagggattggatggaggtgatggg

SEQ ID NO: 67902 - DNA, 201 bp, Homo sapiens
tgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaa

SEQ ID NO: 67903 - DNA, 201 bp, Homo sapiens
gctggcctcccccagtatcgccgctacttccttaactccacctccaacccccctttgcccttccctgtgtctgcccccattttccttcccctcccctcccyagctgtgggctgagctagagacggggtcagagagactggagagatggtaggcgtggctgaggtatcggggtgctcccctggatggtgctctgggggggtc

SEQ ID NO: 67904 - DNA, 201 bp, Homo sapiens
gaggccatcacctggccctggcatgggactttggggcccagaatgttggcctgaggtctcagagcctgatctgccagccagaggtggtgctagaggcccasgaaagacacttcgtcctttaaatatctttgtgagcgctgctgtgtgagaaccatgcttggcacttggcttctggcggaggaaacacccaaagctggcagc

SEQ ID NO: 67905 - DNA, 201 bp, Homo sapiens
atacccagtccacataaaatttctgctcctgcctcaaaaatgtccagaacgatgtatgaattttaaaactgttagaagggttcatggcttctgctcacgcrgttctctgaactgaagtggggtccccaggctctagcccccgggggaggtgaggtgaggggcaggcctcccgggggctgacgtggccacccttgtccgccc

SEQ ID NO: 67906 - DNA, 201 bp, Homo sapiens
ctcaaaaatgtccagaacgatgtatgaattttaaaactgttagaagggttcatggcttctgctcacgcagttctctgaactgaagtggggtccccaggctstagcccccgggggaggtgaggtgaggggcaggcctcccgggggctgacgtggccacccttgtccgcccgcagtggtgaccatcatcaaggggaaggtgga

SEQ ID NO: 67907 - DNA, 201 bp, Homo sapiens
aggcagctttttgttttctgctcccctttctttttcctcctgagcacttggcaggagctgccatcacctgagatcagggggcttccgggggagctgggggrgcttctcggagacagggtctgggcagagatccagtgtggtgggtctgagcaggcaggaggatggaaggcttggagcctggagtcgccgggagtggtctgg

SEQ ID NO: 67908 - DNA, 201 bp, Homo sapiens
cagtggagtggggcgcctgcattctaggaggtctggacagagttagggtggcactgccaggtttgggtgttggagaggagggagcaaggaatctgggctcraacccacatggtttattgggagccggataggcaggatgcagagtgaaggaggagccgaggctgggtgccagtgagggagggctagcaggaaggggacagc

SEQ ID NO: 67909 - DNA, 201 bp, Homo sapiens
gcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctg

SEQ ID NO: 67910 - DNA, 201 bp, Homo sapiens
cacggcgtctctgtgccattcttgccctaggagatgctgaaggacgaggtgcgcaccctcacttaccgcaactccatgtttcataaccggcacctcttcawggacaaggtggtgctggacgtcggctcgggcaccggcatcctctgcatgtttgctgccaaggccggggcccgcaaggtcatcggggtgagtctccagggt

SEQ ID NO: 67911 - DNA, 201 bp, Homo sapiens
acgccctggtggcctacttcaacatcgagttcacacgctgccacaagaggaccggcttctccaccagtgaggcggggcccacagggctgggggccgttccygagccagggcggaggcgcacccacgtagtggagggggtgacagaaacgggcagaaggaaccatggggacacgcgtgttccagtgtgagctctgccatgta

SEQ ID NO: 67912 - DNA, 201 bp, Homo sapiens
aggacctgaagggtgacatcccaggaggggcctctgaaatttcccacaccccagcgcctgtgctgaggactccctccatgtggccccaggtgccaccaatraaaatcctacagaaaattctctcctgagtgcttctttactctggggaaggggctgcgggagagggtaggggcttccagagagggcagggtctgcaggaga

SEQ ID NO: 67913 - DNA, 201 bp, Homo sapiens
ttttcagtagagacagggtttcaccgtggtctcgatctcctgactttgtgatccgcctgcctcgacctcccaaagtgctgggattacaggcgtgagccacygcgtccggccattcctccccattctaaccacatgatccccaaggatctctatccatcccggtatcccaacctaagggggttccaataacaaatttttggc

SEQ ID NO: 67914 - DNA, 201 bp, Homo sapiens
ggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtggggggctctgggagaggtcagtgctgagtaaggcaattcccagcagcttgagccccacca

SEQ ID NO: 67915 - DNA, 201 bp, Homo sapiens
ccccattctaaccacatgatccccaaggatctctatccatcccggtatcccaacctaagggggttccaataacaaatttttggccgggcagggtggctcaygcctgtaatcccagcactttgggaggccgaggcgggcagatcacttgaggtcaggagttcgaaaccagcctggccaacatggtgaaacttcgtctctact

SEQ ID NO: 67916 - DNA, 201 bp, Homo sapiens
tgaggtcaggagttcgaaaccagcctggccaacatggtgaaacttcgtctctactaaaaatacaaaaaaattagccaggtgtggaggcacgcgcctgtagkcccagctactcgggaggctgaggcaggagaatcacttgaacccgggaggcggaggttgcagtgagccgagatcataccactgcactccagcctggctgac

SEQ ID NO: 67917 - DNA, 201 bp, Homo sapiens
aaggagaaactcaagattgactcatgaggacctgaagggtgacatcccaggaggggcctctgaaatttcccacaccccagcgcctgtgctgaggactccckccatgtggccccaggtgccaccaataaaaatcctacagaaaattctctcctgagtgcttctttactctggggaaggggctgcgggagagggtaggggctt

SEQ ID NO: 67918 - DNA, 201 bp, Homo sapiens
tccggcctcgccatgaggctcttcctgtcgctcccggtcctggtggtggttctgtcgatcgtcttggaaggtaaaagtgggatgggagaattgcggagttrgagatttggaagagtgaaggtggctacaggcctggggtcccggcttagaggacctctgagagctccggggccccttctgggtcgtggttgcctcatcgtg

SEQ ID NO: 67919 - DNA, 201 bp, Homo sapiens
gaggctcttcctgtcgctcccggtcctggtggtggttctgtcgatcgtcttggaaggtaaaagtgggatgggagaattgcggagttggagatttggaagartgaaggtggctacaggcctggggtcccggcttagaggacctctgagagctccggggccccttctgggtcgtggttgcctcatcgtggtcgggtgggtctc

SEQ ID NO: 67920 - DNA, 201 bp, Homo sapiens
ttgagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatga

SEQ ID NO: 67921 - DNA, 201 bp, Homo sapiens
tgagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgac

SEQ ID NO: 67922 - DNA, 201 bp, Homo sapiens
cgcatgcgcaatgcaacgtctgccttaggcccggaacttcggtgcctgggcgcagcggtgcacccggacccggaacattctcaggcgaaagtgtctcttgygtgcgtgggccggaggttagtgtgcggggcccgccgggcggttgaaaagtccgagagaatcaggatggaggccgtggcgacggcgacggcggcgaaggaa

SEQ ID NO: 67923 - DNA, 201 bp, Homo sapiens
gcagcggtgcacccggacccggaacattctcaggcgaaagtgtctcttgcgtgcgtgggccggaggttagtgtgcggggcccgccgggcggttgaaaagtycgagagaatcaggatggaggccgtggcgacggcgacggcggcgaaggaacccgataagggtgagatcttggtcacgcgcaggcggcgggtgggtgcggtt

SEQ ID NO: 67924 - DNA, 201 bp, Homo sapiens
gagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgacg

SEQ ID NO: 67925 - DNA, 201 bp, Homo sapiens
acgatcttggctcaccgcaacctctgcctcccaggttcaagctattctcctgcctcagcctcccgagtagctgggattacaggcatgtgccacaatggctrattttgtatttttagtagagacggggtttctcccagttggtcaggctggtcttgaaatcccgacctcaggtgatccacctgccacagcctcccaaagtgc

SEQ ID NO: 67926 - DNA, 201 bp, Homo sapiens
tgagatccctacctcataccatatacagaggcatcaggggaaaccaaaaggagtatgtacatgaccttggggacacagaagccttctgaacaagacacackgtgaaaaccatgaaggaaaaaaaagatagctttttgaccatgacataattaaaagcatccttgtgaccacaacaccagaaccaaagttaaaagatgagag

SEQ ID NO: 67927 - DNA, 201 bp, Homo sapiens
ttctctagggggacatcagggcagtgccccacaacccacacacaccaccatctcactgggtctagtctcatctcagacaacccccacccccactgtttctsgggttccctttctcatctctcccaccctgtctcctgcctctgtctttcttggtgtctgtctgggcttctttctgtctctttctgtctttctgtctctctc

SEQ ID NO: 67928 - DNA, 201 bp, Homo sapiens
gtgggtagattacttgagctcatgagttcaagaccagcctgggcaacatggcgaaatgctgtctctacaaaaaatacaaaaattagctgggtgtggtggcrccctagctactcagaaggctgaggtgggagaattgcttgagcctgggaggtggaagttgtgtgagctgagatcccaccactaagctctagcctgggcgat

SEQ ID NO: 67929 - DNA, 201 bp, Homo sapiens
cttcctgagtagcagggattacaggtgcccaccaccatgcccagctgatttttgtatttttaatagagagagggtttcaccatgttggccaggctggtctygaatttgtggcctcaagtgatctgcccacctcggcctcccaaagtgctggattacaggcatgagccatggtgcccagccagctttcctgttttctttgcc

SEQ ID NO: 67930 - DNA, 201 bp, Homo sapiens
cagcaggcatcactgctgttcccaagccagggcccaggaggaaattgggggtggcagggaccacagtgtgttgcctcgggagggcagcagtggccccgacktgtcccccatccgtgcattcagttggcatgtgctgagcatctgtgatgtccacaggctctggggataaggcggggaccaaaaccaacgaaaggcttccct

SEQ ID NO: 67931 - DNA, 201 bp, Homo sapiens
gtgccccaggcctttgacctgggcatccgagggtcccagggagacccagtccttgacagcctcctcctcctgcagcacagtagacgacaaccccgacttckacaacctcgacatcgtggcacgggatgaggaggagaggtactttgatgaggaagaacctgaggatgcgcccagcccagagctggatggggactgatggcc

SEQ ID NO: 67932 - DNA, 201 bp, Homo sapiens
tgtctcttacctgcctgtatttgtgccccatttttaaagagcagagggcctgggccacaggaaaggtatcagcccttggtgataggcacattttttaccartctatcatttggtcattaaatttgtttacaatatactttgctatacgtaaatttgttgtgtaggtttttaaaaagcgatgagagacacagaaattgagtc

SEQ ID NO: 67933 - DNA, 201 bp, Homo sapiens
caacttctgctgcattgtcctgcatgctgacacccagacagacaggtgtctgtgggcatatgctgggcctcacaggacatgtgtgtgtacataggccatgyacacgtccatgggcaggagcttgtgcatcgtgcctggacacagttgtacacgagctccagaccgtcagagcctcagaggccaggatgtagccaggtctgc

SEQ ID NO: 67934 - DNA, 201 bp, Homo sapiens
cagcagcgtctgctccaacagcaggaggaggaggaggcctgcttggaggaagaggaagaggaggaggacagtgacgaggaaggtgagggccagtagcaggragaccccagattccagacaccccagccctaggcctgtctgtctccacttcatggcagcaggctgggcccccaacctgcaaaagccgacattgcgtccctc

SEQ ID NO: 67935 - DNA, 201 bp, Homo sapiens
cacagtggctcagacctgtaatcccagcactttgggaggccgaggcaggcaaatcacttgagataaggagttcaagaccagcctggccaacatggtgaaascccggctctactaaaaatacaaaaaaaattagccaggcactgtggcaggtgcctataatcccagctactcaggaggctgaggcaggagaatcacttgaac

SEQ ID NO: 67936 - DNA, 201 bp, Homo sapiens
tccaggatgtggggttgaacagccaaaggaagaggctgggtgacctcggactagccttgtccatctcagaccctcagtctcctcacctctaaggcaggggrtggacagggatgacatatagctcagtatcaatgaaaccctgaaacacttccctcctggcaatggcagaggctactaccccaagccccccaagtctcccta

SEQ ID NO: 67937 - DNA, 201 bp, Homo sapiens
tccgggcccccctgctatatgagcagtacatcgggcagtatctcacccaggaggagctcagtgcccgcaccccaacccaccagccccccaagcccgggtcycccgggagacctgcttgcccgctctccaacttgctgctccagtcctacgaggagcgggagctacagcagcgtctgctccaacagcaggaggaggaggagg

SEQ ID NO: 67938 - DNA, 201 bp, Homo sapiens
ccaacaaggcagctgattccaggcctgctcagtgaccctttctctagggggacatcagggcagtgccccacaacccacacacaccaccatctcactgggtstagtctcatctcagacaacccccacccccactgtttctggggttccctttctcatctctcccaccctgtctcctgcctctgtctttcttggtgtctgtct

SEQ ID NO: 67939 - DNA, 201 bp, Homo sapiens
aactgagtctgctagaggatgccacaaacagctgggggtaagattgctggcaggagtggggaagctgagcaggacagggacagtcacagcctatggtgctrcagaggccaggagtccgagcagtttctttgccctggactctgaagacacggctaggaccagtggaggggagggaccagggcaggtttaactgttatttga

SEQ ID NO: 67940 - DNA, 201 bp, Homo sapiens
gcctcttctttctacttgtacatttccacctctctaggcctctgctctcactgtccctctctgtctgtctctcagcctttatctctgggttttgatccccsactccaggctctgggccccttcttcccccttccctcaaacctggctgctataggcagcagaaccctgaccactgagtaatacagccccaggggagggagg

SEQ ID NO: 67941 - DNA, 201 bp, Homo sapiens
cacgtggatgtacacacatacacgccccacagtgaaggcgtgtccactgccagccagactagggccccacaaacaggcacacaacctagagacacacaacytctgctgcattgtcctgcatgctgacacccagacagacaggtgtctgtgggcatatgctgggcctcacaggacatgtgtgtgtacataggccatgtacac

SEQ ID NO: 67942 - DNA, 201 bp, Homo sapiens
cagagtgagacagcattggagggacaagtgtgcatgcagatgtcctcagacgggaaggtttgagaagggtcagatggtaggcgggcctaacaagggctccstgctagccactgtcccgcacacagacaggatcaggtcatcttgatatggagatcagtccccaaatcactgaattgtcccagcagtgctatgccctaggta

SEQ ID NO: 67943 - DNA, 201 bp, Homo sapiens
gccagcttgagtgtagagggaggggggactctacccttctcagccccaccagcccccctctgcccaaccacaattttcccttcctccgccttcctctcccwctcctgtttacactccccaaatgcgcacaggctgttatcatgggtcctgagtcatcccacacacagcctgccccagcgtccctgcccccagctggccgca

SEQ ID NO: 67944 - DNA, 201 bp, Homo sapiens
gaattgtcccagcagtgctatgccctaggtactaccaatatcactcctctatttcccagaggaggaagcagcagctagactccaggaccttggggtcatayctctcagaaagccaagagtgcaggatgagagctgtctgtctcttacctgcctgtatttgtgccccatttttaaagagcagagggcctgggccacaggaaa

SEQ ID NO: 67945 - DNA, 201 bp, Homo sapiens
ggactctacccttctcagccccaccagcccccctctgcccaaccacaattttcccttcctccgccttcctctcccactcctgtttacactccccaaatgcrcacaggctgttatcatgggtcctgagtcatcccacacacagcctgccccagcgtccctgcccccagctggccgcagggcccgccccatggagccccctgc

SEQ ID NO: 67946 - DNA, 201 bp, Homo sapiens
gagactgagacagaaatgtaaagtaagggggagagatagacaggggtccagggaagagaatgggacagacaatgagaatagatcagaatttagtagatgtyagaagtggcatttcagattggtaggctgaggacacagtacacagtgctgtgataattggtcatacctaaggaacaaaacatgagatccctacctcatacc

SEQ ID NO: 67947 - DNA, 201 bp, Homo sapiens
acataagcggaccctacgtccgtcctgaggtgggctcatcaggaaagtgggaattgtgattgcccctgccgtggggcccagccatggtcaccagagcctcytcccattctgggatccctggctcttgaatggaatctggctgctccacttccagccaggcaggcctgctcagagccccagttcctgcacgcaaagtggtga

SEQ ID NO: 67948 - DNA, 201 bp, Homo sapiens
tgttccctccgccaggaatgcctctcctcccacccttcaggtctcagatcctgacccgaggatacagtctccagagcactatatggtcatgtgttttatgygtgtccctggagggcagggaccagggccatctctgtcactagtgtgttcccagagccacccagcgcaaggctgggcacaggagcagcagctctctgtgga

SEQ ID NO: 67949 - DNA, 201 bp, Homo sapiens
cagcatccccatcccccactctgaggcaccaaatgaaccctcgcctccaggtctggacaggctgttccctccgccaggaatgcctctcctcccacccttcmggtctcagatcctgacccgaggatacagtctccagagcactatatggtcatgtgttttatgcgtgtccctggagggcagggaccagggccatctctgtca

SEQ ID NO: 67950 - DNA, 201 bp, Homo sapiens
atgacgcatgcgctgcgcttagaggcggggttaagtcggacctgaactcataacgcatgcgccttatggagcttgctgggggagggaagcggggtggctgrcgtgacgcggaaggcgggtcttttgcgctcgtgggcggagccatagccccttcgggcggggctttccgccgacctgaacccgaaaaggttattttggact

SEQ ID NO: 67951 - DNA, 201 bp, Homo sapiens
gacaccccgcagataggggacatggcttactggtcccaccccatcgacctgcacttcgccaccaaaggtcttcaaggtgggtatcacacctggacccgggkccaggctgaggggagggggccagtagcctctgaggtccctggggctgggaacaccaagacctgtccctgctccccataccacgtaggtcccttttgcagc

SEQ ID NO: 67952 - DNA, 201 bp, Homo sapiens
cccctgtcaaatggagataatacagttacctcacagggttgtgattatatttttcccctcccagggccatggctgaggtgcacgtgatcgggcagatcatrggggccagcggtttctcggaaagtagcctcttctgcaagtggggcattcacacaggtattcccccaagcctggttcatttccacaccaagacccctagcc

SEQ ID NO: 67953 - DNA, 201 bp, Homo sapiens
tcattatcacccctcagtaggatcgaaattgttatgtgtgtttcaggatgcgctcctggagggtacccttggccccatcttaatccttggactaggcttgwaaatatggggtgagaatcgtaataaaatgatattgaagacttatcccgtgctcactatgctcattacccattcatggattaatgggttaatggattagtg

SEQ ID NO: 67954 - DNA, 201 bp, Homo sapiens
gaggacatgggcaaagctatggaaggagagaaagatgcttccagatgccaggtggaaggtggattagagaggggcaagaaagaaggccctgggcccaaagrgagcagggcagggacatgaggagggaaggcaggaggtgtccctgacaaggcccatgatggttacctggggactggaggagcaatgggctgccctgacatg

SEQ ID NO: 67955 - DNA, 201 bp, Homo sapiens; identical to SEQ ID NO: 45611

SEQ ID NO: 67956 - DNA, 201 bp, Homo sapiens; identical to SEQ ID NO: 45610

SEQ ID NO: 67957 - DNA, 201 bp, Homo sapiens
acctcagcctcaggggtgtgacgaagctagcttggaatcctagtactaccctttacttgctgggcctcagtttccccccctgtcaaatggagataatacasttacctcacagggttgtgattatatttttcccctcccagggccatggctgaggtgcacgtgatcgggcagatcatgggggccagcggtttctcggaaagt

SEQ ID NO: 67958 - DNA, 201 bp, Homo sapiens; identical to SEQ ID NO: 45613

SEQ ID NO: 67959 - DNA, 201 bp, Homo sapiens
aattagtagcgcgcagagcgagtacaaagctaggggaggagcctgctgttgccccagcaacaaccacggaaaccaagacgagcgcggtcgcggaagtatcrcggcttacatatctcgcagccaggcgggtcctgggagaggcgcgagccaggcctggtcggcgcccgcggagaaaagaagcagtcaagcccatgaactaca

SEQ ID NO: 67960 - DNA, 201 bp, Homo sapiens; identical to SEQ ID NO: 45616

SEQ ID NO: 67961 - DNA, 201 bp, Homo sapiens
aggcaggaagaggtagtgccaggatttgaacccagatacttggttccagagtccatgcttcgtaacccctaccagtagatgccacagagaaacagtcctayagccacagcggcatccccttcccgatggctgcctcccacccctctatgtcccggctctcactgcaggggcggcatggaagctcctgtcaggcgtgcggga

SEQ ID NO: 67962 - DNA, 201 bp, Homo sapiens
accaagacgagcgcggtcgcggaagtatcgcggcttacatatctcgcagccaggcgggtcctgggagaggcgcgagccaggcctggtcggcgcccgcggaraaaagaagcagtcaagcccatgaactacaaccccggttgccgctttctcctctcctaaccgttaagtgcgctaaggtaggaatgacgcatgcgctgcgct

SEQ ID NO: 67963 - DNA, 201 bp, Homo sapiens
ccttcttaatgaagcttccttgatccccttcttgctaaagcggtatccccaccctcaccctacccagctctgttttccctcacagcaattaccaccatctratctaccctataatttgcttatttactacattcgttgtctaggatatcagcttcacgggggcaggaatttttgtctgccatccatgttcatgtctgccgt

SEQ ID NO: 67964 - DNA, 201 bp, Homo sapiens
caattaggatctgtggtcaagacctcagcctcaggggtgtgacgaagctagcttggaatcctagtactaccctttacttgctgggcctcagtttccccccytgtcaaatggagataatacagttacctcacagggttgtgattatatttttcccctcccagggccatggctgaggtgcacgtgatcgggcagatcatgggg

SEQ ID NO: 67965 - DNA, 201 bp, Homo sapiens
tttgaacccagatacttggttccagagtccatgcttcgtaacccctaccagtagatgccacagagaaacagtcctatagccacagcggcatccccttcccratggctgcctcccacccctctatgtcccggctctcactgcaggggcggcatggaagctcctgtcaggcgtgcgggagggccaaacgcaagtggacacccc

SEQ ID NO: 67966 - DNA, 201 bp, Homo sapiens
aacccagagaggaaaagactgggcctggggtctccagtgagtatcagggagtggggaatcagcaggagtctggtccccacccatccctcctttcccctctstctcctttcctgcaggctggccccggctccatttccaggtgtggtcccaggacagctttggccgctgccagcttgcaggctatggattttgccatgtgcc

SEQ ID NO: 67967 - DNA, 201 bp, Homo sapiens
gcgtggagtgctgagggactctgcctccaacgtcaccaccatccacaccccggacacccagtgatgggggaggatggcacagtggtcaagagcacagactytagagactgtcagagctgaccccagctaaggcatggcaccgcttctgtcctttctaggacctcggggtccctctgggcccagtttccctatctgtaaatt

SEQ ID NO: 67968 - DNA, 201 bp, Homo sapiens; identical to SEQ ID NO: 46386

SEQ ID NO: 67969 - DNA, 201 bp, Homo sapiens; identical to SEQ ID NO: 46388

SEQ ID NO: 67970 - DNA, 201 bp, Homo sapiens; identical to SEQ ID NO: 46370

SEQ ID NO: 67971 - DNA, 201 bp, Homo sapiens
ccgctggtgaccggttacttgggaaggggtcctggcctgaagacagtgtgtgcggcaagaacgcaagggggcaagtcccagaagtaacgccactgctcggrggaaggagcatggggcaggagggcccggctgcttctccaggcccctgcggggggctgcttcggaggaactgcagggcagcctggcccggaggcctccctg

SEQ ID NO: 67972 - DNA, 201 bp, Homo sapiens
ggaagtgagcgtctgtggtgtctgcacacatttggcagggtttgacgtgtgccgtgtgtctgagtgtgggtccgcctgtgtgtgtggtacccacacgtgtrttggggccattgtggtgtggtatctgcacacctgtgtggcaggggctcgtatgtttagctgcatgcacacacacctctgtggtgtctgcataagtgtatg

SEQ ID NO: 67973 - DNA, 201 bp, Homo sapiens
ggaggttggtctctgcctgacctttgagaaacctggctctgtacactactgcttcagagaagggtttgccatccttaaggtcctctgagcatggcagagtygtggagtcttctgcttcctgacacccatggagatgccactcttgaacagtgtctgtgccaagatgttggtttaagctacctccctcgctcccttttccta

SEQ ID NO: 67974 - DNA, 201 bp, Homo sapiens
ctccaggccttatcgtaaatgctggaaatgtatactatggggcaaagatgttcttacctcctggccttcacagcctggtgaggagacaaagaaagaaacargtggttatgatcagtgcgatgagctctctggggctggggaagtacaggaggggcccctgaccctgcctgtgagagtggtgggggagagggcaatgggtca

SEQ ID NO: 67975 - DNA, 201 bp, Homo sapiens
ccttgaggccctccaacattcaatggatgtgtagaggatgaaactgccaaggatagtgacaactggagagaggcaggaagaagaaaagaggctacttgaaraagaagtggtagggtatcatgtcaaaagacacacaggaagaactcaacaaatgtttgatgaatgaaataaaaaatgaattaatgaataaatgagacttgc

SEQ ID NO: 67976 - DNA, 201 bp, Homo sapiens
ggtttttatgtttgaggatgttacccagttggatggcttccctttcctctgtgaatcaggaggggagatcagcctctgagacgggtggccaatggagagtwatgtcctagtctcaggcaggcctttgctgatgtcttggctgtagtaagccccaggttcctgtaatgccctcctcttcctccttcatgatattcagtcaac

SEQ ID NO: 67977 - DNA, 201 bp, Homo sapiens
ctgcccacaagcaggctggggaagggggatattggcccatcctaagtggcagccctgtgggatggatgagcgaccccaggccaggaccttgggagatagtsgcctaacaacggtggagtcaatgtgagagatgacacgtgacctccactagagtgaggcctgcagggcgggcggtctgacaccaaagcaggggccccagag

SEQ ID NO: 67978 - DNA, 201 bp, Homo sapiens
aggtgctgaagtttggttaggtttttatgtttgaggatgttacccagttggatggcttccctttcctctgtgaatcaggaggggagatcagcctctgagasgggtggccaatggagagttatgtcctagtctcaggcaggcctttgctgatgtcttggctgtagtaagccccaggttcctgtaatgccctcctcttcctcc

SEQ ID NO: 67979 - DNA, 201 bp, Homo sapiens
ctgtgtctgttggattgaatgacacaggggtcatgttgaccttggtaggagctgttactgagtcgtgttgggagtggaagcaggtttggaaagggttgagsagtgagtgggaggtgaggaagtggcaacagtgagtggagacaactctctcaggaagtttgcctgtatgggggaggaaagagagcagtgagtggatctgga

SEQ ID NO: 67980 - DNA, 201 bp, Homo sapiens
ccatctctactaaaagtacacaaaaattagccgggcatggtggtgtgtgcctgtaatcccagctactcaggaggctgaggcagaagaatcgcttgaacccrggaggcagaggttgcagtaagccgagatcttgccactgcactgtagcctgggtgacacagcaggactccatcgcaaaaaaaaaaaaaagggaattttgtc

SEQ ID NO: 67981 - DNA, 201 bp, Homo sapiens
ggggcggctgtgtccccagctcagccaggaggcctagcactggcaagaacactgattagaagcagttttcccactgccaattcctaacctgttttgtatcrgcctgtgtatctcttgcattctgagcccctctagctatagtcccagctctctccgcccttcagagtcaacgcttgctgtcttcatttccttacttcccat

SEQ ID NO: 67982 - DNA, 201 bp, Homo sapiens
aggccctggatctgtcaagccgcattctgttgccctcagcgaccgaggggtgtgccctggggcggctgtgtccccagctcagccaggaggcctagcactgscaagaacactgattagaagcagttttcccactgccaattcctaacctgttttgtatcggcctgtgtatctcttgcattctgagcccctctagctatagtc

SEQ ID NO: 67983 - DNA, 201 bp, Homo sapiens
gccccttccccaacagggactttgcctacgtagctcgtgataagctgacccagatgctcaagtgccacgtgtttcgctgtgaggcacctgccaagaacatygccaccagcctgcatgagatctgctctaaggcacggccccctccactccctggactagttgccacctttgctctacaagggtgtgggtggggtcactgag

SEQ ID NO: 67984 - DNA, 201 bp, Homo sapiens
ctcttctgtgtctggcagtgtttcgccgtgcgctccctaggctgggtagagatgaccgaggaggagctggcccctggacgcagcagtgtggcagtcaacarttgcatccgtcagctctcttaccacaaaaacaacctgcatgaccccatgtctgggggctggggggaagtaaggacctgagccgggggtagggggtggtac

SEQ ID NO: 67985 - DNA, 201 bp, Homo sapiens
ccactctagtggtgttcctggcacagtaagccccgggtggatgagctggggggtggggaggcacagagagccattgtgtggaggccttgctggtgggaccragggcaggcgccagctgtgccatcccagaaagctcagggcaggggatatagggatggggtgggcctcagacctgggcctggactgtgatggggatgatag

SEQ ID NO: 67986 - DNA, 201 bp, Homo sapiens
gcttgtgttgggccccagggaactaaagggtgtgggtcagggaggggtctagaggctattcctaggcctcaggcctcccaaatatgcccctccccagtagstacggttccctgcctaggagctggggagggagagatctaatcccttcaaggaagtgataacactggagtggtaacaagaggagcaggaagcaaggccagc

SEQ ID NO: 67987 - DNA, 201 bp, Homo sapiens
ggactgtccgcaggggtgttcagtcgctgtggggctccctgaagcccaaacggctgggggcccataccccatgaagaagcccccaccttccctccacctgmttgtgttgggccccagggaactaaagggtgtgggtcagggaggggtctagaggctattcctaggcctcaggcctcccaaatatgcccctccccagtagct

SEQ ID NO: 67988 - DNA, 201 bp, Homo sapiens
catagtgatccaggacagggcattatgagggctggcagagggaccagtgcccaaggggagctacttcatggaaattgtcaccaagatgtagcttcatctgsccagagaagccatgaattgcagccgagcgccctccctctgtgacctgccttccagtgccatgccctgtagggctggttctgcagcttatttgctcctgtc

SEQ ID NO: 67989 - DNA, 201 bp, Homo sapiens
acaaagatctgaaaggctgaggggcccaggggaaaggctcccatagtgatccaggacagggcattatgagggctggcagagggaccagtgcccaaggggasctacttcatggaaattgtcaccaagatgtagcttcatctggccagagaagccatgaattgcagccgagcgccctccctctgtgacctgccttccagtgcc

SEQ ID NO: 67990 - DNA, 201 bp, Homo sapiens
tcccaacagggaccacccagtgggaaccccccggccgggcctccccctcacaggggagcagcccccaagaggagtcccaggtgaggctcacaggcctgttrattttgggccaggggtggagggagtgtgtgctgctggagtaggataggacactcactcactactcccatccctcctcctagctcacctggacaggttttg

SEQ ID NO: 67991 - DNA, 201 bp, Homo sapiens
ggaataggaacacagccggaggagcttacagtgatggggcttgggatggaagtgcggccggagaggggcagtcagtgatcagtgtccaaaacacacgagcyggtcccactctagtggtgttcctggcacagtaagccccgggtggatgagctggggggtggggaggcacagagagccattgtgtggaggccttgctggtgg

SEQ ID NO: 67992 - DNA, 201 bp, Homo sapiens
tgaccttggcggaggaggccagccaggagcctgagatggcacccttgggccccaaaggcctgatacacctgtactctgagctggagctctcagctcacaaygcagccaaccgaggcctacgaggacctggcctgatcatcagcactcaagagcaggggccagatgagggagaggagaaggcggccggggaggccgaggagg

SEQ ID NO: 67993 - DNA, 201 bp, Homo sapiens
taagccccaggttcctgtaatgccctcctcttcctccttcatgatattcagtcaacaaatagggaatgctatgggtgccaggcactgttctagatgttggygttacactgcattgtaacaagttgttcaatgactgtttcccgctgaactgagaactcctccagaggaagaaccatttcttttgtcttcatcactctcccc

SEQ ID NO: 67994 - DNA, 201 bp, Homo sapiens
gccgagggtgggtccctgggtggcgggctggaaggatagttgggactcaaatggttgcggagaaactgacccacgaagggctgtgaggaggcagagggagsggtctggagggggagctgtccttgcggaacaggacgtcctcttacctgagaggcaggtggagtttgtttggggcaccatgaggcatagtaacgtaaccaa

SEQ ID NO: 67995 - DNA, 201 bp, Homo sapiens
tgaacacatgaagactgaatactccaatacgtggagggactccggttaaagggaggcaggggacgagatgaaagtagggcctcggctgggcaagtgtccarcttatgccctgctggtggggctgcgggtgagcaaggtctgccaccatgatcaaccttctcttctttcccatagtggaattcccagcgcctaagaatgagt

SEQ ID NO: 67996 - DNA, 201 bp, Homo sapiens
cgtggagggactccggttaaagggaggcaggggacgagatgaaagtagggcctcggctgggcaagtgtccagcttatgccctgctggtggggctgcgggtragcaaggtctgccaccatgatcaaccttctcttctttcccatagtggaattcccagcgcctaagaatgagttggtccagaagttccaagtctattacctg

SEQ ID NO: 67997 - DNA, 201 bp, Homo sapiens
cccccaccttccctccacctgcttgtgttgggccccagggaactaaagggtgtgggtcagggaggggtctagaggctattcctaggcctcaggcctcccaratatgcccctccccagtagctacggttccctgcctaggagctggggagggagagatctaatcccttcaaggaagtgataacactggagtggtaacaagag

SEQ ID NO: 67998 - DNA, 201 bp, Homo sapiens
ggctggaaggatagttgggactcaaatggttgcggagaaactgacccacgaagggctgtgaggaggcagagggaggggtctggagggggagctgtccttgyggaacaggacgtcctcttacctgagaggcaggtggagtttgtttggggcaccatgaggcatagtaacgtaaccaaagtgttttctgacactggcagagga

SEQ ID NO: 67999 - DNA, 201 bp, Homo sapiens
tggaaatcacatgcaaacaccttgtagaaggaaaacacatgtcttcgaggaatcagaagaaggctactgaggctgcagagcagtgtgaccaaagccagggrcagggaggaggaaggcaggcgccagactgagcaggaaatttaggccatgttaagaatttggtcttaagggccaggcgtgatggctcacgcctgtaatccc

SEQ ID NO: 68000 - DNA, 201 bp, Homo sapiens
gatgagtagaagttaattcagcttagagagtaggagaagaggtcccaggaagcatggaaatcacatgcaaacaccttgtagaaggaaaacacatgtcttcsaggaatcagaagaaggctactgaggctgcagagcagtgtgaccaaagccaggggcagggaggaggaaggcaggcgccagactgagcaggaaatttaggcc

SEQ ID NO: 68001 - DNA, 201 bp, Homo sapiens
ttccctgtgaaagtgacatttgaactgaaatccaaaaaataagtagaagtgaatgcggtcaagtggaatggaggtgggggtgggatgggggaagatcaggktctacagtgggaggcactttggcatttccaaggtactgaaagaaggccaatgcaagatgaggccgacagctgggcagtggtcaggctgccaggtcaggga

SEQ ID NO: 68002 - DNA, 201 bp, Homo sapiens
cacgagccggtcccactctagtggtgttcctggcacagtaagccccgggtggatgagctggggggtggggaggcacagagagccattgtgtggaggccttkctggtgggaccgagggcaggcgccagctgtgccatcccagaaagctcagggcaggggatatagggatggggtgggcctcagacctgggcctggactgtga

SEQ ID NO: 68003 - DNA, 201 bp, Homo sapiens
tccagttttgactcagatcctctacctcctgcccctcttctgtgtctggcagtgtttcgccgtgcgctccctaggctgggtagagatgaccgaggaggagytggcccctggacgcagcagtgtggcagtcaacaattgcatccgtcagctctcttaccacaaaaacaacctgcatgaccccatgtctgggggctgggggga

SEQ ID NO: 68004 - DNA, 201 bp, Homo sapiens
ctgtgaggaggcagagggaggggtctggagggggagctgtccttgcggaacaggacgtcctcttacctgagaggcaggtggagtttgtttggggcaccatraggcatagtaacgtaaccaaagtgttttctgacactggcagaggagatgccaaagcgaagcctggaggaaatggggactgattcatacattcattcagca

SEQ ID NO: 68005 - DNA, 201 bp, Homo sapiens
aggggacctgctttaccacgggatagctggaggaggggcatcattttgatactgattcctcaatccccttcccaaggatgaacccagtgatgaggccccartggagctgggactgaaggaacctgaggaggggacgttgaccttcccagctcagagcctcaggtgagctgccagatgcagtgagctggcagtgggatggat

SEQ ID NO: 68006 - DNA, 201 bp, Homo sapiens
ccaatgctgccagcctctcagaggctgtgcaggctgcgtgcatggtaagctactagtagggtggtgtggtggtggcgtggccccatgggaggtaggctggrgagtgactgccctgcttgcctccgcagcttcgctaccagaagtgtctggatgcccgttcccaggcctccacctcctgcctcccagcaccccctgctgagt

SEQ ID NO: 68007 - DNA, 201 bp, Homo sapiens
acctgagccatgtcccctactggtggccccacatgtggtgactccagactataggctctaggcagaagcaggaactgtgttgtggtatagctcttccaccmccccttctcaaccatggggtctcagaggggaccgggcataggcaccagctgtctgctctttgggtaggctgaccctcaccaagcctcccacctggcagat

SEQ ID NO: 68008 - DNA, 201 bp, Homo sapiens
tacactgtaatgacttagcacaatgtgatacagagtaatcactcctcagatagatatcttaaaaaataattgggtcttgggagaggactggcctgtagggyctgatttgggagttattgtggtgtgaagcaatgtgatgtctgagtgtgatgagcgctgagagagcatgatttggggaaatcagaactttgagaggtcagt

SEQ ID NO: 68009 - DNA, 201 bp, Homo sapiens
ttcctcagatcatggccgaacggcgtaatgcccgctgcttggtaaatggactctccctggaccactctaaacttgtggatgtccctttccaaggtcagtgkcaaaacccctccaggtccagctcagctttgttggcaaaggtgggtgacccaaggaaaggcatgagctcctggacagcgctgatagaaaaatgaacacatg

SEQ ID NO: 68010 - DNA, 201 bp, Homo sapiens
cccctccactccctggactagttgccacctttgctctacaagggtgtgggtggggtcactgagtgctgtaggggggccccagggcaatgaggctctaatarattctccctggctcctcgcctcccttccttcctcagatcatggccgaacggcgtaatgcccgctgcttggtaaatggactctccctggaccactctaaac

SEQ ID NO: 68011 - DNA, 201 bp, Homo sapiens
tggagggagatgtgccaagctccagaagggcctcccagatggccaaggggggagaaactgcccttccaggacagatcggaaggatgaagctctttgaagcwggaaggtacaggctgacagggatggcagatggattggtgtgtgtgactcagtcaggagatggtgaactggtccccagattccagaagtgtccagccagcc

SEQ ID NO: 68012 - DNA, 201 bp, Homo sapiens
ttagccaccaacagggcccaggaggagacctgagccatgtcccctactggtggccccacatgtggtgactccagactataggctctaggcagaagcaggarctgtgttgtggtatagctcttccaccaccccttctcaaccatggggtctcagaggggaccgggcataggcaccagctgtctgctctttgggtaggctgac

SEQ ID NO: 68013 - DNA, 201 bp, Homo sapiens
agaaagaaacaagtggttatgatcagtgcgatgagctctctggggctggggaagtacaggaggggcccctgaccctgcctgtgagagtggtgggggagagkgcaatgggtcagttttaagaagggacctgtatactgatgtctgaaggagaggtaggtgatagccaggtgaaaatcgagagtaagggaggtgggctgggag

SEQ ID NO: 68014 - DNA, 201 bp, Homo sapiens
tggaagcacccaagctcccctcttctgccctgccccttcccacccgctatgctccaccattaccctccacctcagcatgcttgcctgtctacccctccccyccaagaaggcagcacctatgggggaccagctgtgggcagaagccctggaggagctgtgatgggcagggaggacgtgggtggggtggggaccaggctcagc

SEQ ID NO: 68015 - DNA, 201 bp, Homo sapiens
acagcctggtgaggagacaaagaaagaaacaagtggttatgatcagtgcgatgagctctctggggctggggaagtacaggaggggcccctgaccctgcctrtgagagtggtgggggagagggcaatgggtcagttttaagaagggacctgtatactgatgtctgaaggagaggtaggtgatagccaggtgaaaatcgagag

SEQ ID NO: 68016 - DNA, 201 bp, Homo sapiens
attagccaccaacagggcccaggaggagacctgagccatgtcccctactggtggccccacatgtggtgactccagactataggctctaggcagaagcaggractgtgttgtggtatagctcttccaccaccccttctcaaccatggggtctcagaggggaccgggcataggcaccagctgtctgctctttgggtaggctga

SEQ ID NO: 68017 - DNA, 201 bp, Homo sapiens
gagacctgagccatgtcccctactggtggccccacatgtggtgactccagactataggctctaggcagaagcaggaactgtgttgtggtatagctcttccmccaccccttctcaaccatggggtctcagaggggaccgggcataggcaccagctgtctgctctttgggtaggctgaccctcaccaagcctcccacctggca

SEQ ID NO: 68018 - DNA, 201 bp, Homo sapiens
aaaacaacctgcatgaccccatgtctgggggctggggggaagtaaggacctgagccgggggtagggggtggtactgtgagagtgtgaagggaattatgagmgatgggaggtctgacctgcccacaagcaggctggggaagggggatattggcccatcctaagtggcagccctgtgggatggatgagcgaccccaggccagg

SEQ ID NO: 68019 - DNA, 201 bp, Homo sapiens
gtgggtggggtcactgagtgctgtaggggggccccagggcaatgaggctctaatagattctccctggctcctcgcctcccttccttcctcagatcatggcygaacggcgtaatgcccgctgcttggtaaatggactctccctggaccactctaaacttgtggatgtccctttccaaggtcagtgtcaaaacccctccaggt

SEQ ID NO: 68020 - DNA, 201 bp, Homo sapiens
caggctttatccttacaataaagctgtgaggtaaatattatgatgattcccatattacagataacaaaaaagagatccagagaggtttagtagctttctcsagaccacagacaggctgagattacaatagagctgaaatctaaaccaggtctcagtccaggcctgagctcttggccccgtgttatgctgccgccaatgcat

SEQ ID NO: 68021 - DNA, 201 bp, Homo sapiens
cttccctttcctctgtgaatcaggaggggagatcagcctctgagacgggtggccaatggagagttatgtcctagtctcaggcaggcctttgctgatgtctkggctgtagtaagccccaggttcctgtaatgccctcctcttcctccttcatgatattcagtcaacaaatagggaatgctatgggtgccaggcactgttcta

SEQ ID NO: 68022 - DNA, 201 bp, Homo sapiens
cactttgggaggccgaagtgggcggatcacgaggtcaggagtttgagatcagcctgaccaacatggtgaagccccgtctctactaaaaatacaaaaattayctgggcgtggtggtgggcacctgtaatcacagctactcaggaggctgaggcaggagaatcacttgaacccgagaggcagaggttgcagtgagccaagatt

SEQ ID NO: 68023 - DNA, 201 bp, Homo sapiens
tcccagctactcgggaggctgaggcaggagaatggcgtgaacccgggaagcggagcttgcagtgagccgagattgcgccactgcagtccgcagtccggccygggcgacagagcgagactccgtctcaaaaaaaaaaaaaaaaaaatacttctactaaaggcaaagtctgattgcctctcttttttgtgatgttagtggcct

SEQ ID NO: 68024 - DNA, 201 bp, Homo sapiens
aatgtattttatatgtaagtgtcgcatgaatcgatgcaggagtgaaggtgtgcgttctggaataaatgcatgtgtgtgaaagcaaaggccggggtgggctrcgcttggagggagatgtgccaagctccagaagggcctcccagatggccaaggggggagaaactgcccttccaggacagatcggaaggatgaagctctttg

SEQ ID NO: 68025 - DNA, 201 bp, Homo sapiens
gtgagcataattgtcacatacttcattgttgcaaagaattttttttttttttttttttaaagacaagtctcgctctgtccgccaggctggagtgcggtggygtgatcttagctcactgcaacctccgcctcctgggttcaagcaattctcctgccttagcctcctgaatagctgggattacaggctcccgccaccacgcct

SEQ ID NO: 68026 - DNA, 201 bp, Homo sapiens
tggctaatagaggaagatgagccagcagaggagtctaggaacccagcaaacagtaacaagaagtgtaaaagatgagatgagatgaggagtgtggagatgasagtgtggaggccccggatagaggctggatgagagattcacggggtcagatgctgctgggaggacaaccaagacgagcactgtgtctgttggattgaatga

SEQ ID NO: 68027 - DNA, 201 bp, Homo sapiens
cagggtttcaccatgttggccaggctggtcttgaactcctgacctcaggtgatccacccatctcagcctcccaaagtgccatgattacaggcgtgagccaycgcactcggctgccaacaagtattcttaaacctcagccacaagttatttgttatttatttacttcttacctaattgggctgaattttttttttggagacg

SEQ ID NO: 68028 - DNA, 201 bp, Homo sapiens
  misc_feature (1)...(201): n = A,T,C or G, or insertion/deletion polymorphism (see Tables 1-2)
tttctcccccgatgagtccaatccatgactgcctttaactctgtggcttccttcccctagaggaaagccagaaattgtgggaagcaatttagacacactgntgagcatagggctggatgagaagtttccacaggactacaggctggcccagcaggtgtgccatgccattgccaacatctcggacaggagaaaggtatgtgg

SEQ ID NO: 68029 - DNA, 201 bp, Homo sapiens
cagctactcagaaggctggggcaggaggatcgcttgaacccagaagtttgaggctgcagtaagctatgatcctgcactgcacttcggcctgcgcaacacarcaaaccctgtctcaaaaaaaattgtttacaaaggtgtttttgttgttgttgttgttgttgttgctttttttttgagacggagtctcactctgtcacccag

SEQ ID NO: 68030 - DNA, 201 bp, Homo sapiens
tttttttttgtggggggacagagcttcactcttgtcgcccaggctggagcgcagtggttcaatctcggctcactgcagcctctacctcctgggttcaagcrattttcctgcctcagcctcccgagtagctgggattacaggtgcccgccaccacaagctgatttttgtatttttaatagagacgggttttgccatgttggc

SEQ ID NO: 68031 - DNA, 201 bp, Homo sapiens
tatcccgccactcccaggagcttccagctatcctggatgatacaactttgagtggatcagatagaaacgcccatctaaatgccctcaaaatgaactgttaygctctgatacgtctcctggaatcctttgagaccatggccagccagacaaaccttgtggacctggaccttggtgggaaggtaatttggagttttgggctca

SEQ ID NO: 68032 - DNA, 201 bp, Homo sapiens
acgttgaatatatagatctggagttcaggagagaggtctgagctagagataacacatttgggaatataatagtattcagagccgtgagactgaatgaaatyaccaaatcagtaagtgtagctaaaagagcaggaatccaaggactggtaccctagggcactccagcattaagagtgaggatgccgggtgcatggctcacgc

SEQ ID NO: 68033 - DNA, 201 bp, Homo sapiens
taggaagtctgttcctgtcctccctgtgcagggtatcctgtagggtgacctggaattcgaattctgtttcccttgtaaaatatttgtctgtctcttttttwaaaaaaaaaaaaaggccgggcactgtggctcacgcctgtaatcccagcactttgcgataccaaggcgggtggataacctgaggtagggagttcgagacca

SEQ ID NO: 68034 - DNA, 201 bp, Homo sapiens
tgcctctggatattgatatctctgatgagcatgtacccagcttgccaccgtatttattcagttgaacaatttcacgtgtatttttaaacattcgattccaygggttagatctgatctgttagaaggggctctgcaggctccttcctgtctcacccccacactttctttccctcatagtcactttcgaagtatagatcctgg

SEQ ID NO: 68035 - DNA, 201 bp, Homo sapiens
aggaagtctgttcctgtcctccctgtgcagggtatcctgtagggtgacctggaattcgaattctgtttcccttgtaaaatatttgtctgtctctttttttwaaaaaaaaaaaaggccgggcactgtggctcacgcctgtaatcccagcactttgcgataccaaggcgggtggataacctgaggtagggagttcgagaccag

SEQ ID NO: 68036 - DNA, 201 bp, Homo sapiens
ttgcagtaagtgaaacacccaactggtactttaaaaagaactggtgactgtttgtcctaactgtgcatgttagtcctgaaattccaagttataggttcacygataaatgcctctggatattgatatctctgatgagcatgtacccagcttgccaccgtatttattcagttgaacaatttcacgtgtatttttaaacattcg

SEQ ID NO: 68037 - DNA, 201 bp, Homo sapiens
catagtctctaaaattaattatacaaagcttaaaaataaataatataaagaagaagatagtaggacctgtcatttcatgttggatcatcagagaaggcttkctgttacgtcacgtttgagcagagaccttaagaaagtaaggaaataaactatgcagattgttagggaagagcattccaagcaaacagaaaagcctatgca

SEQ ID NO: 68038 - DNA, 201 bp, Homo sapiens
agaaggggctctgcaggctccttcctgtctcacccccacactttctttccctcatagtcactttcgaagtatagatcctggcctcaaagaagatactctgsaattcctgataaaaggtgtttatgggtcagggggtaggggatggaaggtgtttgttatcgtttgtttgtttgtctgtttgtttgtttttcctacattttg

SEQ ID NO: 68039 - DNA, 201 bp, Homo sapiens
gtaagtagacttggtccaccaaaagagaaggaattaaatggaaacagggatgaaattatgtcatttactgaccctgctattcattttacctgatagcttastgatgctgaccttgccggaccactgcagaaggagacccagaaattacaagagatgagggcccagaggcgaactgcagcagcttgtaagtagttactgcct

SEQ ID NO: 68040 - DNA, 201 bp, Homo sapiens
gtttatgggtcagggggtaggggatggaaggtgtttgttatcgtttgtttgtttgtctgtttgtttgtttttcctacattttgtcagccacatgatgataycaaggctgttgtgattcagttggtttggctaagcccagggacctttggcctgttaaaggtctgtaatcttggtgggcgatacagagttatgtgtgttcac

SEQ ID NO: 68041 - DNA, 201 bp, Homo sapiens
gaaaagtggaggggtgaatcagtatgttgtgcaagaggtactgtccatcaaacatcttccaccacagcttagaggtaagagtccatagctgtcactgtacytagctctttcaaaggaccatctcacatggaattgctacattgtcatttctgttccactacaccaggaagcatcataagagcaagaaacatgtttttccta

SEQ ID NO: 68042 - DNA, 201 bp, Homo sapiens
gtctagtaagagcaactcagctttgattttttttttttcttggaggtaggatctggctctgtcacccatgctggagcatgatcatagctcattgcagcctygatctcctgggctcaagcaatcctcccacctcagcctcccaagtagctgggacttcaggcacatactaccatgcctggctaatttttttagtttttgtag

SEQ ID NO: 68043 - DNA, 201 bp, Homo sapiens
gttgaaaagtggaggggtgaatcagtatgttgtgcaagaggtactgtccatcaaacatcttccaccacagcttagaggtaagagtccatagctgtcactgkacttagctctttcaaaggaccatctcacatggaattgctacattgtcatttctgttccactacaccaggaagcatcataagagcaagaaacatgtttttc

SEQ ID NO: 68044 - DNA, 201 bp, Homo sapiens
tgaagcaatttggcttttcttgtaatgtcatgactcttttctgcttcttgggaacacttccagcatcactagtggcacttcattatgggtcccatggtgtyatgtaaggtttatgatactgctttagacacatgaaaaatacctgaggaaccacaggagatcacttcttgctgccatatgcaatttttgttttgagacaga

SEQ ID NO: 68045 - DNA, 201 bp, Homo sapiens
tccccttccggcaatctctgctcctctgctattacatgaagcgaagagtttctgcctctctgtggctactaccgtaggaaaggttcgtgtgaacaatgacraaactgtcagtgatcacccaggaaggaaagatttaggtaaatgcagagtgtggagttagagacctcagcataaaacagaggctttgtgtctgaggcaggg

SEQ ID NO: 68046 - DNA, 201 bp, Homo sapiens
gtgagcatagggctggatgagaagtttccacaggactacaggctggcccagcaggtgtgccatgccattgccaacatctcggacaggagaaaggtatgtgrgggtggttccaaactaaggagagtggagattctcgtgtccaccctgtacacacacccacgttgtcttgctctccacagccttctctgggcaaacgtcacc

SEQ ID NO: 68047 - DNA, 201 bp, Homo sapiens
ccacaaggtgagaggcagagaggcactgagggctggctgcagagggaatctgtaggtcacctcatctccttaacatggctctctctgtcttacagggcaaygcaatctataatctccttccagatatcatcagccgcctgtcagaccccgagctgggggtggaggaagagcctttccacaccatcatgaagtattgctccc

SEQ ID NO: 68048 - DNA, 201 bp, Homo sapiens
gcttaggaatcagacacacctgtatttgaattccacctcggctactctttagctgtacagccttcggcaataacttagcctctctttgtgcctatttcctyttcttttgaggctgatgatacttaacccttagttcttgaaaatattaaatacgataaagttcctaacatggtggcagacatacagtagcactcactccct

SEQ ID NO: 68049 - DNA, 201 bp, Homo sapiens; identical to SEQ ID NO: 33799

SEQ ID NO: 68050 - DNA, 201 bp, Homo sapiens
agaggcagagaggcactgagggctggctgcagagggaatctgtaggtcacctcatctccttaacatggctctctctgtcttacagggcaatgcaatctatratctccttccagatatcatcagccgcctgtcagaccccgagctgggggtggaggaagagcctttccacaccatcatgaagtattgctccccgggccctgg

SEQ ID NO: 68051 - DNA, 201 bp, Homo sapiens; identical to SEQ ID NO: 33800

SEQ ID NO: 68052 - DNA, 201 bp, Homo sapiens
tcacttgaacctgggagccggaggttgtagtgagccgagatcgtgccactgcacttcagcctgggtgacagagcgagactccatctattttttttttttttaaaaaaagatggtgaaaccccgtctctactaaaaaatagaaaaattagctaggtgtggtggcaggcacctgtaatcccagctactcgggaggctgaggca

SEQ ID NO: 68053 - DNA, 201 bp, Homo sapiens; identical to SEQ ID NO: 33804

SEQ ID NO: 68054 - DNA, 201 bp, Homo sapiens
cgtggcagagaacatcagagaagacgagtgctgggggagggtccagggttggtcttagtggatggcagagctggccctgggccatcgaacatcctcatctycccttcctgcagacagctcctctcctacatcaccaaggacaagcagacagagagcctggtggaaaagctgtgtcagcggttccgcacatcccggtatgct

SEQ ID NO: 68055 - DNA, 201 bp, Homo sapiens
agtagagcttttacaggaatgctgatggattggattggattatagggttagtaaaggaatctgagatgagaatgattacaaggctttttttttttttttttgacagtcttgctctgttggctctgtcacccaggttggcgtgcagtggcgtgatcttggctcgctgcaacctctgcctcccaggttcaagcaattctcatg

SEQ ID NO: 68056 - DNA, 201 bp, Homo sapiens; identical to SEQ ID NO: 33805

SEQ ID NO: 68057 - DNA, 201 bp, Homo sapiens
agcttcactcttgtcgcccaggctggagcgcagtggttcaatctcggctcactgcagcctctacctcctgggttcaagcaattttcctgcctcagcctccygagtagctgggattacaggtgcccgccaccacaagctgatttttgtatttttaatagagacgggttttgccatgttggccaggctggtcttgaactccta

SEQ ID NO: 68058 - DNA, 201 bp, Homo sapiens
aacctcctcagttcaagcaattctcctgcctcagcctcctgagcagctgggattacaggcgcatgccaccacacctggcttttttttttttttttttttgkatttttattagagacggggtttcaccatgttggtcaggctggtctcgaactcctgacctgatgatccacctgcctcagcctacaaagtgttgggattaca

SEQ ID NO: 68059 - DNA, 201 bp, Homo sapiens
cacttgaacctgggagccggaggttgtagtgagccgagatcgtgccactgcacttcagcctgggtgacagagcgagactccatctattttttttttttttwaaaaaagatggtgaaaccccgtctctactaaaaaatagaaaaattagctaggtgtggtggcaggcacctgtaatcccagctactcgggaggctgaggcac

SEQ ID NO: 68060 - DNA, 201 bp, Homo sapiens
agagacgggttttgccatgttggccaggctggtcttgaactcctaacctcaggtgatctccctgctttggccccccaaagtgctgggattacaggtgtgarccaccacgcccagccagaagtctatttttaaaataagtaaaataagtttgatggaagaaggttgtgattttaaatcagctactctaggcccggtgcggtg

SEQ ID NO: 68061 - DNA, 201 bp, Homo sapiens
tctactaaaaaatagaaaaattagctaggtgtggtggcaggcacctgtaatcccagctactcgggaggctgaggcactgaattgcttgaacccaggaggcrgaggttgcagtgagctaacatcatgccactgcactccagcctgggcgacagagcgagactccgtctcaaaaatatgtatatatatttgtgagggtggagc

SEQ ID NO: 68062 - DNA, 201 bp, Homo sapiens
aatccaggggaaatgatgaactagtgaagcaggagatgctggtacagtatctgcaggatgcctacagcttctcccggaagattacagaggccattggcatmatcagcaagatgatgtatgaaaacacaactacaggtatgccagagtccctttctataaggacagccttggggttcttttggattttttaattttttaaat

SEQ ID NO: 68063 - DNA, 201 bp, Homo sapiens
cacaagctgatttttgtatttttaatagagacgggttttgccatgttggccaggctggtcttgaactcctaacctcaggtgatctccctgctttggccccscaaagtgctgggattacaggtgtgagccaccacgcccagccagaagtctatttttaaaataagtaaaataagtttgatggaagaaggttgtgattttaaa

SEQ ID NO: 68064 - DNA, 201 bp, Homo sapiens
ccccacactttctttccctcatagtcactttcgaagtatagatcctggcctcaaagaagatactctggaattcctgataaaaggtgtttatgggtcagggrgtaggggatggaaggtgtttgttatcgtttgtttgtttgtctgtttgtttgtttttcctacattttgtcagccacatgatgatatcaaggctgttgtgat

SEQ ID NO: 68065 - DNA, 201 bp, Homo sapiens
acgtcacccccccttccggctgcctcaggaacacaggttgtttgagcgactgcgggagacagtcacaaaaggtgagctctcagggaaggccttgggcagawttgggccctttgttgcagtaaacaacttctccctcctcctctgcaggctttgtccacccagacccactctggatcccattcaaagaggtggcagtgaccc

SEQ ID NO: 68066 - DNA, 201 bp, Homo sapiens
aaagaaaaaattccagtatatttactgaaaaaaattagcatattagtggacctacacaattcaaatcgtattgttcgaagattaattgtagacatacatakgtgccttacttttctccagtgagagggcctaaaggcagtaatactctaatagaaatgagtgcaagtaatgcctagaatttggcttctacataccattatt

SEQ ID NO: 68067 - DNA, 201 bp, Homo sapiens
gccttacttttctccagtgagagggcctaaaggcagtaatactctaatagaaatgagtgcaagtaatgcctagaatttggcttctacataccattattccrtaatagccaggattccaccaagaatggttgattacaggactgggccagggaaaatacaagatgagcccagaacatcttttattttatttatttatttatt

SEQ ID NO: 68068 - DNA, 201 bp, Homo sapiens; identical to SEQ ID NO: 33790

SEQ ID NO: 68069 - DNA, 201 bp, Homo sapiens
caggagaatcgcctgaacccagaggcggaggttgtagtgagccgaaatcacaccattgcactccagcttgggcaacaatagcgaacctccatctcaaattwaaaaaaaaatgcctacacgctctttaaaatgcaaggctttctcttaaattagcctaactgaactgcgttgagctgcttcaactttggaatatatgtttgc

SEQ ID NO: 68070 - DNA, 201 bp, Homo sapiens
aggccagagagctgacagctgagagcaggtacgagggttaggccgtgaggccatgggagcagtggggagccagaccgcaggttcttgtgggccatcatggkgactttggcatttcctcagaatgaagtggagccactggggagccacaagcagggaggtgaggtgacctgacttgtacttcaacagggccatcctagctgt

SEQ ID NO: 68071 - DNA, 201 bp, Homo sapiens
ggagtcttgctctgtcaccgggctggagtgcagtgctgtgatctcagctcactgcaacctccgcctcccaggttcaagagattcccctgcctcagcctccygagtagccggaactacaggcgtgagccaccgcacccagctaattttttgtattttagtagagacgggtttcaccatgttggccaggatggtctcgatctc

SEQ ID NO: 68072 - DNA, 201 bp, Homo sapiens
cagagcatgggataattgattcctgctgagggccttttctaccagtgttagggtgtagcccggaggtctcggtccccatgacccgcaattccattcctagyctccgggaccctgctcagcaagtgcggaaaacagcggggctggtgatgacccacctgatcctcaaggacatggtgaaggtgaaggggcaggtcagcgaga

SEQ ID NO: 68073 - DNA, 201 bp, Homo sapiens
ttttccttaaggtagagcttacaggatttgctaacagactgggtgtgaggtgggagggagagttcagtcaaggatgactctcccgggttttggtctgagcrtttggaagactggagttaatggtaactgagatagggagaaggctgtgaataggtgttttgggaggaagatcagatgttctgttttggacatacaaagttt

SEQ ID NO: 68074 - DNA, 201 bp, Homo sapiens
tacgagcaatagcaaggaggccagagagctgacagctgagagcaggtacgagggttaggccgtgaggccatgggagcagtggggagccagaccgcaggttyttgtgggccatcatggtgactttggcatttcctcagaatgaagtggagccactggggagccacaagcagggaggtgaggtgacctgacttgtacttcaac

SEQ ID NO: 68075 - DNA, 201 bp, Homo sapiens
tacagcgtgctaagtgttgttctgactggtttgcatggactatctcattcagttttgacatatatatatacatatatatatatatatatatatatacacayatatatataccattggtccttgaacaacgtgggggttagggatgacaacccctgtgcagtcaaaaatctgcatatgtaagttttgactgccccaaaactt

SEQ ID NO: 68076 - DNA, 201 bp, Homo sapiens
catacagcgtgctaagtgttgttctgactggtttgcatggactatctcattcagttttgacatatatatatacatatatatatatatatatatatatacayacatatatataccattggtccttgaacaacgtgggggttagggatgacaacccctgtgcagtcaaaaatctgcatatgtaagttttgactgccccaaaac

SEQ ID NO: 68077 - DNA, 201 bp, Homo sapiens
accatacagcgtgctaagtgttgttctgactggtttgcatggactatctcattcagttttgacatatatatatacatatatatatatatatatatatatayacacatatatataccattggtccttgaacaacgtgggggttagggatgacaacccctgtgcagtcaaaaatctgcatatgtaagttttgactgccccaaa

SEQ ID NO: 68078 - DNA, 201 bp, Homo sapiens
gcacattcaaaccatacagcgtgctaagtgttgttctgactggtttgcatggactatctcattcagttttgacatatatatatacatatatatatatatakatatatatacacacatatatataccattggtccttgaacaacgtgggggttagggatgacaacccctgtgcagtcaaaaatctgcatatgtaagttttga

SEQ ID NO: 68079 - DNA, 201 bp, Homo sapiens
tgtatatactatggttttttccctctacctgcctacctatggtaatgtttaatttacaaattagatacagtaagagattaacaacaattctttttttttttgagacggagtcttgctctgtcaccgggctggagtgcagtgctgtgatctcagctcactgcaacctccgcctcccaggttcaagagattcccctgcctcag

SEQ ID NO: 68080 - DNA, 201 bp, Homo sapiens
acctaaacacctcccattagactccaccttccaacactgtcatgttggggattatatttccaacacatgaattatgaggggcacattcaaaccatacagcrtgctaagtgttgttctgactggtttgcatggactatctcattcagttttgacatatatatatacatatatatatatatatatatatatacacacatatat

SEQ ID NO: 68081 - DNA, 201 bp, Homo sapiens
aaaaattagccgggtgtggtgacgcgtgcctgtaatcccagctactcaggaggctgaggcgggagaatcacttgaacctgggagccggaggttgtagtgasccgagatcgtgccactgcacttcagcctgggtgacagagcgagactccatctattttttttttttttaaaaaaagatggtgaaaccccgtctctactaaa

SEQ ID NO: 68082 - DNA, 201 bp, Homo sapiens
gtagtcatgagtttaacgtaagactagtcagcttgtttctgtgtttttctcaggccatttttatttgtgtggtcacatgaatggagtaaccagaaagttgrtttaacctagatttgccaggggagtatgtgttgttgttgttgttaattagtggaataagttacaagtatcacagtatctaacaataggggaatagtaaat

SEQ ID NO: 68083 - DNA, 201 bp, Homo sapiens
tatgttgggggtggggaactaacaaaaccagatgatgttactagcttgctataaaactaaaagccattatatatgttggggatgggaaagtaatagaaccrgatacgaagacaggtcttgaatatagaccctgactttttcactgtttggtttctagccctgtgagcctgtaggagtagaatggctccccaaatgtatgag

SEQ ID NO: 68084 - DNA, 201 bp, Homo sapiens
tcaagaccaagtgccaaagtcactactagaattagtttctagtccagggtcaatctcagatcccgtaagataatgttactagcttgctataaaactaaaarccattatatatgttgggggtggggaactaacaaaaccagatgatgttactagcttgctataaaactaaaagccattatatatgttggggatgggaaagta

SEQ ID NO: 68085 - DNA, 201 bp, Homo sapiens
agcggggccctgcaggggagaaaggcccatccctcaccccttcaatgcccccactgtggcatccctgggactggggaggctgatggggaaggttgagcctytactagctggatctcccagttcctcacaaagcccttcctatctgcagaactgagcggcagcagcgagacctggcctactgtgtgtcacagctgcccctca

SEQ ID NO: 68086 - DNA, 201 bp, Homo sapiens
agccgcctgtcagaccccgagctgggggtggaggaagagcctttccacaccatcatgaagtattgctccccgggccctggggcacattttccacatagcaygggcttaggaatcagacacacctgtatttgaattccacctcggctactctttagctgtacagccttcggcaataacttagcctctctttgtgcctatttc

SEQ ID NO: 68087 - DNA, 201 bp, Homo sapiens
catccaaacacccagcagcgagcttccaaaaagaaacccaaagttgtcttctcaagtgatgagtccagtgaggaaggtatgatgctcccgcctgttcccgrccgagaaggcacacagctagggtgcagagggctggtttccataggacctgctgcgggggcctgagtgtagatgctctgccccactgccgcagaagggcct

SEQ ID NO: 68088 - DNA, 201 bp, Homo sapiens
caattctcgtgcctcagcctcccaagtagctgggaccacaggcgcgcaccaccacaccgcactaatttttttatttttagtagagacagggtttcaccatrttggccaggctggtcttgaactcctgacctcaggtgatccacccatctcagcctcccaaagtgccatgattacaggcgtgagccaccgcactcggctgcc

SEQ ID NO: 68089 - DNA, 201 bp, Homo sapiens
ctgaccacaccactacattccgtcctggtggtgaaggttgcagtgagctatgattgtgccactgcacttcaccctgggtgacagagtgagaccctgtttcaaaaaaaaaaaaaaaaaagtagtgaggcatctgtggaagtcttcagatcatttccatgaccatggaaatgctgtttggagccaggccctggagatggagag

SEQ ID NO: 68090 - DNA, 201 bp, Homo sapiens
ggctccagttctggcctttggggttcaagatcactgggaccaggccgtgatctctatgcccgagtctcaaccctcaactgtcaccccaaggcacttgggaygtcctggacagaccgagtcccgggaagccccagcactgccgctgccacactgccctgagcccaaatgggggagtgagaggccatagctgtctggcatggg

SEQ ID NO: 68091 - DNA, 201 bp, Homo sapiens
ctttttgtagagacagggtcctactatattgcccaggctggcctcggactcctgggctcaagcgatcttccgcctcagcctcccaaagtgctaggattacsggcatgagccaccacgcctggcctgggccttagatttcttatatttaaagtaagcataatgacattcatttggtgaatttgtgagaaccaaaaacaaaga

SEQ ID NO: 68092 - DNA, 201 bp, Homo sapiens
aggaaggggatgcagggacaggaggatgcaggactcataccccatcttctcccctcaccagaaatgggtcaggtggagatctcttcttgcacagtggaccrggacaccgtgtgtggctgcaggaagaaccagtaccggcattattggagtgaaaaccttttccagtgcttcaattgcagcctctgcctcaatgggaccgtg

SEQ ID NO: 68093 - DNA, 201 bp, Homo sapiens
ggtagcctgaacaggtaaagggaagtgcctgcgtcctggggtgcttcagcccaggtgggattatgtctcctaagggacagaagcctggcctggagctggargaaagggaaaacaaagggaatgcaacatccttctgaatttctcaccattcagtgggcaatgcagagctcacagtgtgtgtgtgtgtgtgtgtgtgtgtgt

SEQ ID NO: 68094 - DNA, 201 bp, Homo sapiens
tggcctgagaaagcctctctccctccctccctccagggaggctcatcccccactggccagaggtccctgaaaagctccctttaaggctgtctggggctggsgtcccccagttcttcatcatgactctgcctcaagccccctggatgggattcaaagtaccagtgaccttaggtgctccagtggcttcttcggggaaaggaa

SEQ ID NO: 68095 - DNA, 201 bp, Homo sapiens
tgcccgttttgggtgtcctcaccagcaaggctgctcgggggcccctggttcgtccctgagcctttttcacagtgcataagcagttttttttgtttttgttwtgttttgttttgtttttaaatcaatcatgttacactaatagaaacttggcactcctgtgccctctgcctggacaagcacatagcaagctgaactgtccta

SEQ ID NO: 68096 - DNA, 201 bp, Homo sapiens
gccgtctcttcttttagctgtaagaaaagcctggagtgcacgaagttgtgcctaccccagattgagaatgttaagggcactgaggactcaggtgaggagargtgacctggtgcccatgctcacctgccctctccctcttcttgcccccacccgtccatccatcccacccatccatctatccctgcggcccccctctgcccg

SEQ ID NO: 68097 - DNA, 201 bp, Homo sapiens
gaaaacaaagggaatgcaacatccttctgaatttctcaccattcagtgggcaatgcagagctcacagtgtgtgtgtgtgtgtgtgtgtgtgtgtgtgtgtgagagagagagagagagagagagagaagtggggtaggggagtagggaagaatgatacaggagagactgtggcaaagcaaacaggattttgctgctctcaaa

SEQ ID NO: 68098 - DNA, 201 bp, Homo sapiens
aaaacaaagggaatgcaacatccttctgaatttctcaccattcagtgggcaatgcagagctcacagtgtgtgtgtgtgtgtgtgtgtgtgtgtgtgtgtgagagagagagagagagagagagagaagtggggtaggggagtagggaagaatgatacaggagagactgtggcaaagcaaacaggattttgctgctctcaaag

SEQ ID NO: 68099 - DNA, 201 bp, Homo sapiens
gaagatttaaaaagtgtgtaggacggatgggagcaggagagaggctagaagacacttgcaataacccaggtgtgaggcaacccaggaatgcggagaggacygagagatcacagggggaggcctcgcaagatgaactgacacatgggatggcggcagggatagggatggggccctggggagagagcgtggcaagttctcagc

SEQ ID NO: 68100 - DNA, 201 bp, Homo sapiens
gaatcactggcttctactagagtggaagacagatgtatcattagatcgatcagttgatccatatttatctgctcccagtctggaggtctggttctgggagytgagaggacaccaggggaggataagacactttctgaccaagacattttttgatctctcatcttataaggttcgtggtcactttggggagatcatatctgt

SEQ ID NO: 68101 - DNA, 201 bp, Homo sapiens
gcagtggcgcgatctcggctcactgcaacctctgcctcccagattcaagcaattctcctgcttcagcctcccaagtagctgggattacaggcacgtgccaycatgcctggctaatttttgtatttttagtagagatggggtttcaccatcttggtcaggctggtctcaaactcctggtgatccacctgcctctgcctccca

SEQ ID NO: 68102 - DNA, 201 bp, Homo sapiens; identical to SEQ ID NO: 46666

SEQ ID NO: 68103 - DNA, 201 bp, Homo sapiens
cctcctgtattctgtgggtctgacaaccaactcctctctggccgcccccaccctgtccctcgtcacttcctctgtcctgtggggtgggggtgcaggcgctyctcctttagctgtgccgcacttctccctacaggccaggagaaacagaacaccgtgtgcacctgccatgcaggtttctttctaagagaaaacgagtgtgtc

SEQ ID NO: 68104 - DNA, 201 bp, Homo sapiens
gggaggatcacttgagcccaggattttgagaccagtctgagcaacgtaacaagaccctgcctctactaaaaataaaaaaaaattagctgggcatggtggtkcacggccgtagtcccagctattcaggaggctaaggtgggaggactgcttgagcgtgggtggtggagggtgcagtgattgcatcactgcactccagcctgg

SEQ ID NO: 68105 - DNA, 201 bp, Homo sapiens
aggcccccaaacccagcacaactggtcagaaccagccaggctgtgggaatgcggtgaacccagggtgggagggcagccttggcttgcttcctgctgggackggggagtgttgggggatggagtgagagctcacggaatgggtttagctgttggagacttgttgaactgggaggaggagctggggcggggcctcagctaaag

SEQ ID NO: 68106 - DNA, 201 bp, Homo sapiens
ctggcatgggcctctccaccgtgcctgacctgctgctgccactggtgagaccagggacaaagggaagagtgggctggtgggcgaggcaccttccggctggygtgggccctctccgggagggggccgagcctctcctgcccgggcctggtcctggcgccagcctcaggcctgcaggtcctaacctcagccactgccagtgtg

SEQ ID NO: 68107 - DNA, 201 bp, Homo sapiens
aagcttcagtcccactccaggcttcacccccaccctgggcttcagtcccgtgcccagttccaccttcacctccagctccacctatacccccggtgactgtmccaactttgcggctccccgcagagaggtggcaccaccctatcagggggctgaccccatccttgcgacagccctcgcctccgaccccatccccaaccccct

SEQ ID NO: 68108 - DNA, 201 bp, Homo sapiens
cagaaggtggccctggatggctggggagatgtcgagctgcatcagtagctctctcgtccctggggccacataggccctgaggcatgtcaccacaagtcccyactgccagctgagtccagggtgccagggctgagagaggaagtgaaatttatgatgctttctttctttttcctcagtttgtgggaaatcgacacctgaaaa

SEQ ID NO: 68109 - DNA, 201 bp, Homo sapiens
ccatattatgataagagccaaaagtagatagggtcagttcacgtgcttcgagttcacagggactatgggtctaaggagccggggtggaggaaacagacatygtcaatggtggcttcacgggagggagatgggatctcaactgggcccttggaggagaagctgccacgacctcccccaacaccttgacattaaatgaacaga

SEQ ID NO: 68110 - DNA, 201 bp, Homo sapiens
tgttgtccctagcatggggctccttccttgtgttctcacccgcagcctaactctgcggccccattcacaggaacctacttgtacaatgactgtccaggccyggggcaggatacggactgcagggagtgtgagagcggctccttcaccgcttcagaaaaccacctcagacactgcctcagctgctccaaatgccgaaagggt

SEQ ID NO: 68111 - DNA, 201 bp, Homo sapiens
gggaccgtgcacctctcctgtgagcgcagctctcctgaggccaagccctctccccaccccaggggttggccccttccccatgcggtggcacttcctttccktccccctcctgtattctgtgggtctgacaaccaactcctctctggccgcccccaccctgtccctcgtcacttcctctgtcctgtggggtgggggtgcagg

SEQ ID NO: 68112 - DNA, 201 bp, Homo sapiens
acataggccctgaggcatgtcaccacaagtccccactgccagctgagtccagggtgccagggctgagagaggaagtgaaatttatgatgctttctttcttyttcctcagtttgtgggaaatcgacacctgaaaaagaggtgagatgaaatgagagagttactcccaaatgtccctgaccattccttataattgcctaatgc

SEQ ID NO: 68113 - DNA, 201 bp, Homo sapiens
tggccccttccccatgcggtggcacttcctttccttccccctcctgtattctgtgggtctgacaaccaactcctctctggccgcccccaccctgtccctcrtcacttcctctgtcctgtggggtgggggtgcaggcgcttctcctttagctgtgccgcacttctccctacaggccaggagaaacagaacaccgtgtgcacc

SEQ ID NO: 68114 - DNA, 201 bp, Homo sapiens
actggcttctactagagtggaagacagatgtatcattagatcgatcagttgatccatatttatctgctcccagtctggaggtctggttctgggagctgagrggacaccaggggaggataagacactttctgaccaagacattttttgatctctcatcttataaggttcgtggtcactttggggagatcatatctgtcaccc

SEQ ID NO: 68115 - DNA, 201 bp, Homo sapiens
ccgtgcaacctccatccctttgttttcgtcacaagaggaatgaatatctatgttgacccacccttaggcatagaacaaacagaaataaggaaagtatatgrtgttcttaatatgtgtttcattttcttttctttcttttccagaaagtattttggagaaaaaattggactgtattttgcctggctgggattatatacatca

SEQ ID NO: 68116 - DNA, 201 bp, Homo sapiens
aaaacaagatggggtaagataagctagaatgcaataaatattagtattcattataagaaggatgggtaagtgttgcttcattagattttgtttcatttttrtaagtgtgtttgtgagagtgagggtatgtatttgcatactgaaatctgatgtaacagattgttttaactgtaggtcacagtcaaaaacgtttaaaattac

SEQ ID NO: 68117 - DNA, 201 bp, Homo sapiens
actctaagggtttgtgtctttcagccactcataactgtgattaaaaacttacagtattcctgggattattttagaggttgctaattttgtcatcaagcctkaaattcactctgtctcactttttaaaacctttttattttgaaaaattttagattcacagcgcaggaacttgcaaagatagtacagaggggcccagcgtgc

SEQ ID NO: 68118 - DNA, 201 bp, Homo sapiens
ggagagcagctgcgtcccgggagcacacgggcagtgttcagcccatcgagagctggagcagggagcaggaggaaatggaattgtgaccatagactcctggractgttcacaggcagggttggtagaacacactgaagttggggcttgttgcctgggaagtcactggcagctctgtgtctccttatcaaacaggagcattgt

SEQ ID NO: 68119 - DNA, 201 bp, Homo sapiens
cattccttcagtctgacttcctcccttcatggagacaccagtcggtcagcactctgggcactgttgtgtgcacagccctcctcgggaaccaaggaaggagyggtaggaagaggagggacttactaccattcttagtatccccagaccaaagccagtgttaggagggaatacacccactcgagaaaggcctcaaatccaagg

SEQ ID NO: 68120 - DNA, 201 bp, Homo sapiens
accaaagccagtgttaggagggaatacacccactcgagaaaggcctcaaatccaagggagaaaaacatgcaaatcagtgtatgcaaaatgtcatgtcagawgaaaacatgcacatcagtgcaccataatgtagctgcaagtaaaacaaatgcagctttaagtaactgtgtattcaaccagtgcataggtgtttgatattct

SEQ ID NO: 68121 - DNA, 201 bp, Homo sapiens
tgagatcataaagccagagagtcagggatatgtcagaatgccctgggggcctcctgagggccaaaggagaggcagggtgtcaggtgctggttgtctttgawgtctgtgaatgaagaaagaaacactaaacctctgtggtataagccagtgcactatgtgtgaaactgaggagttggggaggcgtgagctaagggaaaggat

SEQ ID NO: 68122 - DNA, 201 bp, Homo sapiens
aaactggtccttccaatagaaagaactctagaagtttgaatgtgggtgatctagtggggaaatgtttgtattatttgtcccatttgatttagctgaaataygtctcatatatatgagagagacagagagagaggaggctgggggaggtgggtagggtagagtgcctactccgctaatgccgtagaatgtttccaaaaaaga

SEQ ID NO: 68123 - DNA, 201 bp, Homo sapiens
tgtgctggaagagtgacggagcaggggaatctggcacaggcggaacgtgataattcatgcacaggcctggccaaggtctttcccacccgtttctttgggtwttcagctcctcatttttagcgccaagcttctgttcctcctctggagccctagtgctcctcctctgtgccaattgtttggaagattctaaaacctctgtgt

SEQ ID NO: 68124 - DNA, 201 bp, Homo sapiens
gcaggggaatctggcacaggcggaacgtgataattcatgcacaggcctggccaaggtctttcccacccgtttctttgggttttcagctcctcatttttagygccaagcttctgttcctcctctggagccctagtgctcctcctctgtgccaattgtttggaagattctaaaacctctgtgtgagccattgagagctcatgg

SEQ ID NO: 68125 - DNA, 201 bp, Homo sapiens
ttttgagtcttggggtttgagacaccgttcctggatgttgaaagtccacagaggggaggcaagacacccttccctgcacccctggcccctgcctccacccrgctgcagtgtcgttcgtgcccagcaggctgcactgtgagactgctgatggcctccagccccgcacggctctcctcccgatcctgcctctgctctggagac

SEQ ID NO: 68126 - DNA, 201 bp, Homo sapiens
gacacccttccctgcacccctggcccctgcctccacccggctgcagtgtcgttcgtgcccagcaggctgcactgtgagactgctgatggcctccagccccrcacggctctcctcccgatcctgcctctgctctggagacctggggcctgcaggcctgagtgtgtgtgtgagcctgtatgagagtgtttgtgtgtgttagtg

SEQ ID NO: 68127 - DNA, 201 bp, Homo sapiens
caagagcccttgggtggcactgtgccccaacgttgctacacatctctaccagccctctctagcctgacatgccacgaatgggatctccctcctactgcaargcacaggtcaccgtccttgccagggttccccagcactgccaccagagactgtgtggtttgatccatccctccttgtctctgggctctgcttccaccctcc

SEQ ID NO: 68128 - DNA, 201 bp, Homo sapiens
tgagtaaataaataataaaaaataggtaaaaataaacttctatctccagtagtagtaggttaggatatttgtaacatcccattttgctaaaatttattttwaaaaattggataaatgtatttttcaatcttctcaaagcctcgaagggctgacaggataggaagtaataccaggctaaaatctaaaggaaaatgggaacca

SEQ ID NO: 68129 - DNA, 201 bp, Homo sapiens
ctccgtgtttcccccactgccctgggctgggggaaagcacctctggaagggcagggatccagatgagcaggaaacactgtggacttcctttctctagaggmctctcagaatggtcagagtcctgttggcttggggtgtaatgaacctgccatgcacagcaggtaccctaaagacaccttcctccccaggcttctctgcaga

SEQ ID NO: 68130 - DNA, 201 bp, Homo sapiens
gtggcactgtgccccaacgttgctacacatctctaccagccctctctagcctgacatgccacgaatgggatctccctcctactgcaaggcacaggtcaccrtccttgccagggttccccagcactgccaccagagactgtgtggtttgatccatccctccttgtctctgggctctgcttccaccctcctgaactgtgagcc

SEQ ID NO: 68131 - DNA, 201 bp, Homo sapiens
gagctaggtgcctgagctttcctcctgtgccccagatactcattttcttacacttggatattgggagtccaccatcagaaatcctcctccacagcctggaytctcatcatagccccttcactgatctccctatttgcacactgcccctgacagatcatcagcatgctaacttttaaaacctaaaccaactcacatcactcc

SEQ ID NO: 68132 - DNA, 201 bp, Homo sapiens
tctagaaacatcagtgtgatgtgatgcagcaccacagacccctcgaattctcagaatacattttaaaaccaagctaggattgcatcactcagtgatttacygaatcatggtaaaacctcacatgtggctgacttaggtcatcacacctaaagaaaacataaccaggctggaactgtttcacagaaggaaaagtaatgtgat

SEQ ID NO: 68133 - DNA, 201 bp, Homo sapiens
gggacccacagtttccatttggacttcctgcaggcttctcgacccctacttcctgttcacctcctgcgcccattctctcatttgccacctgtcttccatcygctccaagccctcatcacctctgcctttttccagcttccccttcccctccagggtctatgtttctgattattccccacagttggagttccttgcattctt

SEQ ID NO: 68134 - DNA, 201 bp, Homo sapiens
tgaatactatgtcttattttttctatttttattttgtactcattaaccattcccacttcctgcccactcccctactgtccttcccaggctctggtaaccayccttttactcttaatggattattttcatagtgctcttgacagctgggttgatctggatatttttggaagctcacgaagtaatcaaatccactggtttttt

SEQ ID NO: 68135 - DNA, 201 bp, Homo sapiens
atctggtgaggcttgatccctcagctcccatgatgtccctaaagacaaccaatttctctatctttctgctcaaccatctgcagggtccacttcatcttttrttttctcactgatcccccttgctgacccaggacttccctttatggagtgaatcgatggccactgttatcccccagagtctgacggaaggagaaagctgct

SEQ ID NO: 68136 - DNA, 201 bp, Homo sapiens
tacatttttgcatatcttttccctctagcctttttgaggtataactgatgtataataaactgcacatatttaaagtatccaatctgttgagttttgacatrtgttcaaaaccatcactgtgaaaccatcactgtcttgtaatcaagaaaatgaacatatctaccacccccaaacatttccacaggtccttttgtaaagtct

SEQ ID NO: 68137 - DNA, 201 bp, Homo sapiens
tcaggctccagaacccatggccttcccggggcctatcttacatggtgaggattattccctatttcttccacctgtaggatttctgaagtagaataacaccyagagaagcctgagtcacactctgttgctgactccccataggttaggtctttcaaggtgccgtgctgcctttggggtcctctgcagctcaggggttgagtg

SEQ ID NO: 68138 - DNA, 201 bp, Homo sapiens
aattttgtctcaaaaaaagaaagaaagaaagaaagaggttttcccttataaaaccatcagatcttgtgagcttattcactaccacgagaacagtatggggkaaaccgcccccatgattcagttacctcccaccaggtccctcccgcaacatgtgggaattatgggagctacaattcaagatgagatttgggcagggacaga

SEQ ID NO: 68139 - DNA, 201 bp, Homo sapiens
attattttcctatttatacttctatatccaaatacagtaattggcttaagtaacagcttctgcctcagtaagaggtgtctgcaaagaaggatattagcatsttttaaagcttgtccatatttcataattcttacatttgactttgaggaaaaagattcataaaaccgctttgaattatgccagtcaaaacaaattatcttg

SEQ ID NO: 68140 - DNA, 201 bp, Homo sapiens
aaagaaggatattagcatgttttaaagcttgtccatatttcataattcttacatttgactttgaggaaaaagattcataaaaccgctttgaattatgccastcaaaacaaattatcttgagatcaaaagtcttataagtataagttgataaataaattaattgagttttaaatatagttaatactgcatcccatgtgctag

SEQ ID NO: 68141 - DNA, 201 bp, Homo sapiens
cactgtaccttttctctacttggagaaaagttccagggaaggagggatcttgtgtctaggactggcagtatagcctcagtgcctggaaagagctcagagtwtagcaggtgcttgatgactcctggttgaagacatttgttggatgtatctctggacttacctctttacatcagacaaatgtggtcctgagcaggcttgggt

SEQ ID NO: 68142 - DNA, 201 bp, Homo sapiens
gtctgagtgcttaggaagctaggcttgctttaaaaagttaagggttatggccgggtgcagtggttcacgcctgtaatcccagcactttgggaggccgaggsgggtggatcacctgaggttaggagttcaagaccagcttggtcaacatggtgaaaccccatctctactaaaagtacaaaaaaatcagctgggcctggtggc

SEQ ID NO: 68143 - DNA, 201 bp, Homo sapiens
aaaaaaagaaagaaaaaaaagatgagggagctttgaactggggcccagcatggggggaggtgagccacagccacacctagagggattcaagcaaactcctytgtgtgctgccacatcatgtcctggaaagccagagataatcagaaacatcctgtcggtcagctgagggtgcctcccttagcccctgtgcagggtctggaa

SEQ ID NO: 68144 - DNA, 201 bp, Homo sapiens
gagcttcagaatttgtgctgtggttcgtaaaaaaactcagagtatgtatgttggggggacatggggatgctctttgggatacctgtctctgtgtgccaccygtctttgaaagcgaggaggggtggggagagagagagagagaggagagtttatgtctttcttaatctggttcttgaaaaaaaattccactagattgaaaat

SEQ ID NO: 68145 - DNA, 201 bp, Homo sapiens
ccgagttcagattcaactggctccctgaatgcttgtccacctgagctggcattgatgtgagctatacccactcgcgtgcttttctgaacctaaatgtagakccttacagttgacccgttcaaatgtcccttgttaagttcagccaaccttgctaggcacctgagatcttcacggatatacctgctgccaagcagtgtttta

SEQ ID NO: 68146 - DNA, 201 bp, Homo sapiens
ccaccccatagcaatatacaatggataattttatggaaatcacatgtaacttttattgaccactgactcattgaattttaattccatagacgggaatgccraggaaccggaattgtgtacactgaggctgtggttctaatataaacattgcttgggtatatatgcatgattggtcaaataactttcaggaaccatgaataa

SEQ ID NO: 68147 - DNA, 201 bp, Homo sapiens
tgtgtccatctttcctctggcaaagagaaggccgaaaatttggcttcctaacccagagcctggagatacccctgccacccagttggcgccctgaggatctyggctcaagtgtgggcaggcttggagccagtgtccaggcacttgtccagatctctggttggacagcccttcagaattcctaatgtaaatgatgctgtcaca

SEQ ID NO: 68148 - DNA, 201 bp, Homo sapiens
ccaggcacttgtccagatctctggttggacagcccttcagaattcctaatgtaaatgatgctgtcacatctggtggagggtagagatatagccatcaagcrtatgcagcccatgttccaaactaagtctttctcaatcagcgtcaggacatctttaaggccaccccaggaacctacatgtaaaaatctgccagcatcaatt

SEQ ID NO: 68149 - DNA, 201 bp, Homo sapiens
agactgaggtctataggggaacataagttgatcaatgataatacatggcagagccagagtcgaagccaggcagtctgactcaaaagcaatgcttttaaccycttgctcctgtgtctgctgaaagttttccttcaatagatcctcaaacactcctaaaaagtcatgtttgattcttctttcctaaactaaaggcagaaagga

SEQ ID NO: 68150 - DNA, 201 bp, Homo sapiens
tgatatcttgtggaagcgaaaaacgatcaaggtctctccaaataagattatgacacaaagctggagagttgatataaccctgagggaggacagtaaaagtrtattaatggccttgccagctgaagggaaattgcttctggtgggcctaatggacaggaatggaggaaaaggcatttgccaagtcagtggctgcataccagg

SEQ ID NO: 68151 - DNA, 201 bp, Homo sapiens
accaagacaggcctcccagtctcagaagggccgtacaactggaagtacatgtgtcccactctccgtggccctgagactggggcaagcacatgagttgcacraatggccacagcagatgagaatgcacagatcattgagatctttattttacagatgaaaaaactgaatcccagaaggagaacattcctatagcaagtaatg

SEQ ID NO: 68152 - DNA, 201 bp, Homo sapiens
gccattctcctgcctcagcctcctgagtagctgggactacaggcgcccgccactgcgcccggctaatttttttgtatttttaatagagacggggtttcacygtgttagccaggatggtctcaatctcctgacctcgtgatccacccgtctcagcctcccaaagtgctgggattacaggcgtgagcccccgtgcccggccag

SEQ ID NO: 68153 - DNA, 201 bp, Homo sapiens
gaaaccacatctggtacagaagctgcaattgaagttaccacttggttaagcttacagtaatcccctgttattctccaagatccatctgtcttctgcacagkccaaatgggagagttgaagagggatgtggtgggaatcaccacccctgtgtctttcagtccttgatggtggcactaatctctgcacaccctccagggatgc

SEQ ID NO: 68154 - DNA, 201 bp, Homo sapiens
gggagtggctggaactgacacctgaggagctctgtgacccagcagaattctgtgcttttcctggggagagcttcttctaagaagaggtggccacgacagcygatagaaggctgtgacctgagtgcaagccacgtgccagccactttctgtatgtgagaccgtgctgcttgccaaaagctgttagttccttccattctggct

SEQ ID NO: 68155 - DNA, 201 bp, Homo sapiens
cttgatggtggcactaatctctgcacaccctccagggatgcgatattgtttctgatttactatttttctaggtagagccagctctaatggcttccatttgwcctttcccaccatagtagctctcaccctaccagtcagggagccgatgtgggggttctgccagctgctaagtatgtctatgctaattatgcattctggcac

SEQ ID NO: 68156 - DNA, 201 bp, Homo sapiens
accctccagggatgcgatattgtttctgatttactatttttctaggtagagccagctctaatggcttccatttgacctttcccaccatagtagctctcacyctaccagtcagggagccgatgtgggggttctgccagctgctaagtatgtctatgctaattatgcattctggcactggggaaatgaccacaggattagtct

SEQ ID NO: 68157 - DNA, 201 bp, Homo sapiens
tgagacatttcaactaagctagagacatttcctgctctgttatatatttcacattgcttgtccctggaaaaattacctaccttagactgacaggcctgggmcttcctacagaaatatctgtgccctggttctcccttctgtgatgacaaggaccaaattatgtgttacagctcattttacacgaactgaagttttagttgc

SEQ ID NO: 68158 - DNA, 201 bp, Homo sapiens
aaatttttgcaatttatccatctgataaaggtttaatatccagaatctgcaaggagcttaaacaagtttataagaaaaaaaaaacattaaaaagtggggaraggacaggaatggacacttctcaaaagaagacattcgtgcagccaacaaacatatgaataaaagctcaacatcactgatcattagagaaatgcaaatcaa

SEQ ID NO: 68159 - DNA, 201 bp, Homo sapiens
ttctgtgatgacaaggaccaaattatgtgttacagctcattttacacgaactgaagttttagttgcctgttgagatttgggagcccctccagtcatattgrttacttatttataacatcttctttagggatggattgtatcctctgacggctaatctcttcatgttgtgttaaatttcctgtcgatttcagcaacttatat

SEQ ID NO: 68160 - DNA, 201 bp, Homo sapiens
gttttcagtattttgctattagaaataatgctgtcacaaacatattttttccttttacttttagttgatgtaactgtacatacttatgggatacagagtgrtattttgatacatatatgcaatgtgtaatgattaaatcagggtagttagcgtatctgtcacccctaatatatcatttctttgtgttgtaaatattcacaa

SEQ ID NO: 68161 - DNA, 201 bp, Homo sapiens
catcacagtttgaaaataaagacaaagggtaatgtgttaacattcataatcattgtgatctcctcttagcgagagggatgatgctgtttgccatctttcascaaaaacataatttctggggccgtgatggagagctgggcttgcaggtcagcttcacagatggtttcttttcttaccctttattttcacttagttggaaaa

SEQ ID NO: 68162 - DNA, 201 bp, Homo sapiens
atgggcgggaaccagggctgcgcgtggcgcttgggggccagcgcgagttctgggtgggcgtgggcttggcaggccccgcacttggagcaaccagccggccygccggccgtgggcagtgagaggcttagcacctgggccagcagctgctgtgctcgacttctcgtggggccttagctgcctccccacggggcggggtttggg

SEQ ID NO: 68163 - DNA, 201 bp, Homo sapiens
ttttcacttgcattaataagtgccataaaatatctttttattttgttcatcatttcaaaagcacatgtgagcacctcctccatagacagtgttcttcagtkgggggacgtagtcttctatttgccatctatctctctgccaggcacactgaaaatgcagacagtcagagcctgtgagttgaagattttctatatagtcttc

SEQ ID NO: 68164 - DNA, 201 bp, Homo sapiens
tcccagcactttgggaggctgaggcgggcagactgcttgagctcaggagtttgagaccagcgtgggcaacgtagtaagaccgtgtctctacaaaataattwaaaaatatagctatgcatggtggcatgggcctgtagttccagctactcgggagcctgaggcaggaggatggcttgagcccaggagttagaggcagcagtt

SEQ ID NO: 68165 - DNA, 201 bp, Homo sapiens
taagaccgtgtctctacaaaataattaaaaaatatagctatgcatggtggcatgggcctgtagttccagctactcgggagcctgaggcaggaggatggctygagcccaggagttagaggcagcagttagctgtgattgtgccactgcactgaaacctgggtgacaaagcgagtctctgcctcttaaaaaaaaacaaaaaaa

SEQ ID NO: 68166 - DNA, 201 bp, Homo sapiens
catgggcctgtagttccagctactcgggagcctgaggcaggaggatggcttgagcccaggagttagaggcagcagttagctgtgattgtgccactgcactraaacctgggtgacaaagcgagtctctgcctcttaaaaaaaaacaaaaaaaaaaaacccaaaaccaaaaaccaaaaaaacttttatgttcaacagagattt

SEQ ID NO: 68167 - DNA, 201 bp, Homo sapiens
gcattactttaactttcataaagaataaagaactagcttgaaaaaaaaaatgtccttactttggattctcccagatgcagaccctgagccagtgattcaastgcaaaattctgggggaggtagactctccagtagtggagtgagcaagtgagagagacaagggaaggcagcccagaaggggtgcttggtcaatcaggttac

SEQ ID NO: 68168 - DNA, 201 bp, Homo sapiens
aaacagcaaaaggacactagagtgcttccttcttttttcagatcatgaatccattcatgagggcagagctcctcaggacttaagcacttcttaaagacccwgtctcttaacaccatcaccttggggtttaagttccaacatatgaattcttcagggactcatatattcaaaccagaacagtgagagagctgagtttatgtg

SEQ ID NO: 68169 - DNA, 201 bp, Homo sapiens
ttaatatccagaatctgcaaggagcttaaacaagtttataagaaaaaaaaaacattaaaaagtggggaaaggacaggaatggacacttctcaaaagaagamattcgtgcagccaacaaacatatgaataaaagctcaacatcactgatcattagagaaatgcaaatcaaaaaccacaatgagatgctatcttacaccagtc

SEQ ID NO: 68170 - DNA, 201 bp, Homo sapiens
gcataaacatgtgctttcctccccccacctcctttgttctttctactactcgactgttggctttgtcatctccaaagcagactccaggaatttctatggaygttgggtgaactacgtttttgggaagtgacagatgatagaatggggaacatgctccaaacccttgttcacccctgttctgaagtatcccaggggctgttc

SEQ ID NO: 68171 - DNA, 201 bp, Homo sapiens
atggaaaacccaaacaccgcatgttctcacttataagtgggagctgaacaaatgagaacacatggacacagggaggggagcaacacacactggggcctgtygggagatggaagggggtagggagagcattaggcaaaatatctaatggatgctgggcttaatacctaggtgatgggttgataggtgcagcaaaataccatg

SEQ ID NO: 68172 - DNA, 201 bp, Homo sapiens
tgctccaaacccttgttcacccctgttctgaagtatcccaggggctgttcctgtgccttgggcacttctgttcagcagcagaaggaccataaacttcctgycttgatcatgtggggtctttgaggaggcaccacatctaaaagatgccctttggcagtttcccccttacttaggcttgctaacgtttgatgtttttgctct

SEQ ID NO: 68173 - DNA, 201 bp, Homo sapiens
aatgtttctctactgcatgatgaacaaagatgggtgggaaagagagaaagactctcttcatttctgttatgtattcattgtcctggtagctttttccaggytgcctactcttttcagtgaggtaggtttctcttctctttcccagcctcaaccttcactattctgtttctgtatcagaagacaatcaaaacctaacacatc

SEQ ID NO: 68174 - DNA, 201 bp, Homo sapiens
aatgccaagatgacaagaaatagcaatctgaatctgtgctaacattcagctcccccatcccggacttccatgtgtttagtggtttccttactgattctccmaaccttactggaaagaaagaagcctgcccatgtggtccgctcttctttcagatggggcagcccaagtgagattgtcatgaataattgggaacaaagtcca

SEQ ID NO: 68175 - DNA, 201 bp, Homo sapiens
cccagcctcaaccttcactattctgtttctgtatcagaagacaatcaaaacctaacacatcatccacaaattctgacctggcatgtccaggattccagagrgccctggttaccctttgtccagggcctgcagttgggtgatgatgatgagaccaaggagagggcaagctcttacattaagctgtgcattttgttcactaag

SEQ ID NO: 68176 - DNA, 201 bp, Homo sapiens
ttctccctgtcagaagctggctgcagcacagcctgagctgaatgctggcctttgcggtgggatggtttgctttaccagtcattctttatccacagattgtycaaagtcaattccacatctgggagctgatgctggtgcttttcctaaaaaatacttctcaggtttttccagcattctgatgccacattcatgcttttctgc

SEQ ID NO: 68177 - DNA, 201 bp, Homo sapiens
gtgcattttgttcactaagtaaagagttgccttgtgcgtgttctggaggccaactccagccacttctgtgcgttaatcatttgttatgatttgagctcatwggaaaaaaatcccccagccagtggcacaggggggtggctctgtaccctgtggtacagagtaggaagcctggctggatcagctgaggctgtggattccctg

SEQ ID NO: 68178 - DNA, 201 bp, Homo sapiens
ctggtgcttttcctaaaaaatacttctcaggtttttccagcattctgatgccacattcatgcttttctgcatcatggtttcatttatgcttggtctagggycgtgggcctgtattgatttccacagcacctttgggccatttatgcaactgtggtgggagatattttacataagcttggaagagttactgcccaaccaggg

SEQ ID NO: 68179 - DNA, 201 bp, Homo sapiens
cagattattctgattgctgctttgcctctgctgtccattacagtaggtacacccaccttgcctttgatggttgagttggcccctgccacttcaggatccarttattcccattgtatttaaattttatagttgagtgactgtggttcccactgttagatctgacatacagagaagagtgattatagggcccttcaaagatgc

SEQ ID NO: 68180 - DNA, 201 bp, Homo sapiens
tctctttctggggcaacaaataaaatccctccgagcacaggagtgctcattgctggttggttatgccagtctgtctctatttttagaaagagctacaagarggaggaaaagaatctagagaaataagtacagatggattcctccctgaggcagaagctggggtctgtgggatgaagcacagacacaaagccattgtcctgc

SEQ ID NO: 68181 - DNA, 201 bp, Homo sapiens
gagcacaggagtgctcattgctggttggttatgccagtctgtctctatttttagaaagagctacaagagggaggaaaagaatctagagaaataagtacagwtggattcctccctgaggcagaagctggggtctgtgggatgaagcacagacacaaagccattgtcctgccacccagcagtggagtcggagatggatggcat

SEQ ID NO: 68182 - DNA, 201 bp, Homo sapiens
tatgccagtctgtctctatttttagaaagagctacaagagggaggaaaagaatctagagaaataagtacagatggattcctccctgaggcagaagctgggktctgtgggatgaagcacagacacaaagccattgtcctgccacccagcagtggagtcggagatggatggcatgaatctagaataccatgggaatgggtcct

SEQ ID NO: 68183 - DNA, 201 bp, Homo sapiens
ctgtctctatttttagaaagagctacaagagggaggaaaagaatctagagaaataagtacagatggattcctccctgaggcagaagctggggtctgtgggwtgaagcacagacacaaagccattgtcctgccacccagcagtggagtcggagatggatggcatgaatctagaataccatgggaatgggtccttgccctggg

SEQ ID NO: 68184 - DNA, 201 bp, Homo sapiens
gcgcctaagaggccttgtcagccatgtaattttaaaagtttggttttaatcccaacttttataagtcagcaaacattcattcatgtgtagaggacctactracaacagaatcaaaaaccataaacaaatacagaactagacactagagaatgtgcattgtgtaagtgtatcactgtctgtctacactcagtgttgttgctg

SEQ ID NO: 68185 - DNA, 201 bp, Homo sapiens
tgtaattttaaaagtttggttttaatcccaacttttataagtcagcaaacattcattcatgtgtagaggacctactgacaacagaatcaaaaaccataaamaaatacagaactagacactagagaatgtgcattgtgtaagtgtatcactgtctgtctacactcagtgttgttgctgaggggaaacttacctgtggacaca

SEQ ID NO: 68186 - DNA, 201 bp, Homo sapiens
cataagtaataactatggaacttcgatgatccagcgactggaggaggagcagaggaaagcatcaataaataaaaagaggcggacgatgggtgttaatttckgtcaacacgtgtgctcccagctgcagcacacgttctgttcttaggtctggtctgcattcctcctgggtgacctttcctgcctgttgctgggagagacact

SEQ ID NO: 68187 - DNA, 201 bp, Homo sapiens
aggcgtatcatgtacccagggagggcataatggggaacagctggctaacatgtgtctcgccatttctgaggttgttcataattctctgatatccaagaatracagtaataatgatgccactgctgattgtattaataataataaagaggattggggtgtctttcctgaatcctgccgaagtaaagaggagagcctgggctg

SEQ ID NO: 68188 - DNA, 201 bp, Homo sapiens
acctggagaggctgtgaatgcacctttcactgcaggtcagccactcgcatgataagagcttgtgtctgtttttccacaatttcagctctttgtcttcaggrgataagactgtcactcagggccatcttagcagatttgatgctcagaatctgcttttgaagttgggagttagaatccctgagttcatcattttctttcatc

SEQ ID NO: 68189 - DNA, 201 bp, Homo sapiens
attcccagcccctctgagtctcagtgttctcatctataaggtagagatgctaatcctacctggcaggcacacctgacagagtttgtatggaccgtggatgraatgatgctcagggaagtgctgggtacactgcaaaacattccatacatggaagggtttgttatcatccttgtgtttctccagggcttaccacaatcaacc

SEQ ID NO: 68190 - DNA, 201 bp, Homo sapiens
gcttaagtgacaaggtgggctcatagtgtttccattgtctgtgtgaggaaggaactaagggcattgatggaactggtgttgcgagtcctcaggacagcacrgctcccaccactgctgtgatccagcctgtgaacgtcagcgcagctggtgtccttgggtgggcgcttgctgcctgctttggtgccacatgcccgcttccca

SEQ ID NO: 68191 - DNA, 201 bp, Homo sapiens
cccagctactcaggaagctgaggcaagagagttgctcgaaccctggaggcagaggttgcagtgagccgagatcgcaccactgcactccagcctgggtgacrgttagactccgtctccaaaaacaaaaacaaaaacaaaagacaaacatataattcagttcaacttaatccagtctattcatcgagcaccttctctgtgcca

SEQ ID NO: 68192 - DNA, 201 bp, Homo sapiens
atcaagctgatgttagagcagaggaactgctggttggtaaggatgcctcagagatgaaaaggagaggagggtggtctcagagaaccagaagaggagtgggwaagttggtcctggaagaggacttctcactccttccccaagccttgccctgtctcttgacctcccttgactccctgctcttccagctcagctttgtccatg

SEQ ID NO: 68193 - DNA, 201 bp, Homo sapiens
tggtgactgtatactctttgcttgggaaattgggcagcaagtgcagaggagggatagtaaggctcaggaggaaaagagaaaacacaggtgcaagaattcayttatcaattcattcatcaaacatttattaagcacctggagggaggagcaagtctggagaccaggacagtctcttgagcaattcaggttgttcctgatatt

SEQ ID NO: 68194 - DNA, 201 bp, Homo sapiens
ggggtttgatggcttaagggtgggaagctgggtgccctcattctcactcttccctgggtacatttcttccctacctctctgatcttccctcctgcttatcwtgtccaaactgcaggtttgttttcacaaccttccattcattgaaatgccactctgctgctcgtccctttctaagatgctaagaggatgtggcctatggga

SEQ ID NO: 68195 - DNA, 201 bp, Homo sapiens
tgagaatgcacagatcattgagatctttattttacagatgaaaaaactgaatcccagaaggagaacattcctatagcaagtaatgacagagctgggtcttrgaagcacatctcctgtctgtcaggacagagttatcctatatcccaaccttagggcagatctgagaactgacgacagcaaggcaagggaatgggttacgag

SEQ ID NO: 68196 - DNA, 201 bp, Homo sapiens
gttaaatgacaccacttttgaacaacccagttgtctacaccagaaactttggagctgttttgaattgctcctttcctcttacttgccacacccgacgagcmccatggcagggttgaaccactcaccatctctggtatttaccccttcctgctcatcccctgagttcagggcctcatcaccacttgcctggcctacttcagt

SEQ ID NO: 68197 - DNA, 201 bp, Homo sapiens
ctctgtgcctccttctttgtgggtgtctgagcacctcagctgtttgttgcaaagcagacttcattgctgggcatctctttatagactggcataggctgggractcaggaggtcactcgttggccagcaggtttacactgacccacctttgtccctccctgattcttttgtgggaagcacccctttcctcccatgtaagaaa

SEQ ID NO: 68198 - DNA, 201 bp, Homo sapiens
agcatgtagcatagtgcctggcacagatgagcacccagaactgggagctgctctccatcagtatggtggtcctcccttgccctcacgactcatctatccakgactcttttgcccctctcatcattccttcagtctgacttcctcccttcatggagacaccagtcggtcagcactctgggcactgttgtgtgcacagccctc

SEQ ID NO: 68199 - DNA, 201 bp, Homo sapiens
ggagaggctgtgaatgcacctttcactgcaggtcagccactcgcatgataagagcttgtgtctgtttttccacaatttcagctctttgtcttcaggggataagactgtcactcagggccatcttagcagatttgatgctcagaatctgcttttgaagttgggagttagaatccctgagttcatcattttctttcatcactt

SEQ ID NO: 68200 - DNA, 201 bp, Homo sapiens
taaaggctttttgtccctgtttctaaaaccatggcgtattcctgaagaaaataggcattttagattatttaaattgagaatggagaagggagattgatttrtgtttaaatggcagtattagtatgtgttgtggaggttgggagagaagtgatttaaaagtgtagaaatgggagaaagaagcttgagtttgaccaaagaaaa

SEQ ID NO: 68201 - DNA, 201 bp, Homo sapiens
ctccttgcctgtcatgagcagtgaatcaggagtgtcaaatgcatttattttgcataactctctaaacagttcatgccaaggactatcagtgttctccataytattagaagtagagtccttagcatttcggggtctaatcatattaagcagccaactccagaaaccccaaaaccaatgaaagaactccatccttaatattct

SEQ ID NO: 68202 - DNA, 201 bp, Homo sapiens
gtggtgtcctatgcctgtaatttcagctaatctggaggctgaggcaggaggatcacttgagcccaggagttggaggttgcagtgagctatgattgtgcaaytgcactccagcctgggtggcagagtgagactttgtctctaaaaaaagaaaaagagaaaaaaaaaagaaaagaagaaaacaactcaaggatgattgccact

SEQ ID NO: 68203 - DNA, 201 bp, Homo sapiens
tcacttgagcccaggagttggaggttgcagtgagctatgattgtgcaattgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgc

SEQ ID NO: 68204 - DNA, 201 bp, Homo sapiens
cacttgagcccaggagttggaggttgcagtgagctatgattgtgcaattgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgcc

SEQ ID NO: 68205 - DNA, 201 bp, Homo sapiens
gagtgttatcattcgtcagcccatcctcagttttccttgtcaacagcttaaagaaaaatcttttaaaaatacccttaggtggctgggtgcagtggctcacrcctgtaatcccatcattttgggaggccaaggcaggcggatcagatcacgaggtcaggagatcgagaccatcctggctaatatggtgaaatcccgtcttta

SEQ ID NO: 68206 - DNA, 201 bp, Homo sapiens
taaagaaaaatcttttaaaaatacccttaggtggctgggtgcagtggctcacacctgtaatcccatcattttgggaggccaaggcaggcggatcagatcamgaggtcaggagatcgagaccatcctggctaatatggtgaaatcccgtctttactaaaaaaatacacacacacacacacacacacacatgcacacatgcac

SEQ ID NO: 68207 - DNA, 201 bp, Homo sapiens
tcattttgggaggccaaggcaggcggatcagatcacgaggtcaggagatcgagaccatcctggctaatatggtgaaatcccgtctttactaaaaaaatacmcacacacacacacacacacacatgcacacatgcacaaacttagctgggggcatcgtggcatgtgcctgtagtcccagctagtcgggaggctgagacagga

SEQ ID NO: 68208 - DNA, 201 bp, Homo sapiens
agactatggtcagtaattctactgtttagaacacagtgtaactggtaagaattccttcccagacatgagctgtgaccatgaacacatctctcatttccctrcaaagtccttgcagcactcatctcttctgttagcaagaagtccaatatcttcctgtctttctctttggattttctaggagcccagggactaaagcatcca

SEQ ID NO: 68209 - DNA, 201 bp, Homo sapiens
atgcacacatgcacaaacttagctgggggcatcgtggcatgtgcctgtagtcccagctagtcgggaggctgagacaggagaatcactcgaacctgggaggyggaggttgcagtgagccaagatcataccactgcactctagcctgggcaacagagtgagactccatccccaccccccaaaaaaatacccttaaggaaaact

SEQ ID NO: 68210 - DNA, 201 bp, Homo sapiens
aggagaatcactcgaacctgggaggtggaggttgcagtgagccaagatcataccactgcactctagcctgggcaacagagtgagactccatccccaccccmcaaaaaaatacccttaaggaaaactttagtgtgtgagtgaaactaagaattaatactgaaggaaaatgaaagaagctctactccctcttgatgtttggcc

SEQ ID NO: 68211 - DNA, 201 bp, Homo sapiens
accctgtgacccctctttgctgtcccccagtatccccctgaagatttatcctcaggctttgtagctgcgtgtttctccctctaagcctctcgctggtcctyttgaactttttccttctccctcctccaataatcctaagtcttcaccccttttccctctcatcccctgtctttaccaatccatcccagctactctctttcc

SEQ ID NO: 68212 - DNA, 201 bp, Homo sapiens
tggcgggaagtggagtctgccctctttgttgggatcctgctccacagtttggaagcaggtgaaactttcagatggcctctaatcaacctggggtgcttccyggcggaggtgctatgttagggggcacgtgaataatagagagggttgcctatctcctcaccctctctccattagattcccctccatcgtatccccatagcc

SEQ ID NO: 68213 - DNA, 201 bp, Homo sapiens
ccatcagaggaggcctcctggaaggttcagtggctaagctgagttttgaataatgaattgctatgagttgggtatagagagggggatggacattccagataggggggaatagcatgaattaaggcatgaaaggtcgaaaaagcacaattgttgaggggttacaagtagctgactgtagctggaatgaagagtgtgcatgag

SEQ ID NO: 68214 - DNA, 201 bp, Homo sapiens
gttttccatgggtaaagtgagaccatggagacccaccttacataattgttgagaggattgtttaaaatacatattttggccaggtgtggtggctcacaccrgtaatcccagcgctctgggaggctgaagcaggaggatcacttgagaccaggagttcgagatcaacgtgggcaacatgaagagacctcatctctataacat

SEQ ID NO: 68215 - DNA, 201 bp, Homo sapiens
gaaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgt

SEQ ID NO: 68216 - DNA, 201 bp, Homo sapiens
aaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgtg

SEQ ID NO: 68217 - DNA, 201 bp, Homo sapiens
ccattataaggctactagtggacttctcagcagaaaccttgcaggtgaggagagagtaggatgatatattcaaagtattgaaatttaaaaaacctgccaaycaagagtactatatctaggtcaaagaataaatcaaaaaaggaaattagaaaatatctcaagacaaatgaaaatgaaagcacaacatattaaaacttatga

SEQ ID NO: 68218 - DNA, 201 bp, Homo sapiens
ttccagatgacatgatctcatatgcagaaaaccctaaagactctaccaaaaaacttttagaaataataaattcagtatagttgcaggatactaaatcaacmtgcaaaaatcattttcatttctgtgcactaacaacctatctaaaaagaaaactaagaagaaaagtaccattcacaatagcaccaaaaagaataaaatacc

SEQ ID NO: 68219 - DNA, 201 bp, Homo sapiens
gaaactattttgaaaattatctagcagataatgaaaactaaccaataaacctctatctgctagaaataaatatatatagaaattaacaaaaatattattgktatatatatgatttttatatgccatgtatatatgtgtatatatatgtgtacacacacacacacacacattcacacacacacgaccatggatagatttttt

SEQ ID NO: 68220 - DNA, 201 bp, Homo sapiens
caaaagcaaaaatagacaaatgggaatatatcaaactaaaatgcttctacacagcaaaggaaacaatcaacagagtgaaagtcaatatgcagaatgggagaaaatatttgcaaaccatatatctggtaagggattaatatccaacatgtataaggaacttctacaattcagtggcaaaacaaagaaacacacaaaaaacca

SEQ ID NO: 68221 - DNA, 201 bp, Homo sapiens
ataaacctctatctgctagaaataaatatatatagaaattaacaaaaatattattgttatatatatgatttttatatgccatgtatatatgtgtatatatrtgtgtacacacacacacacacacattcacacacacacgaccatggatagattttttttttcttgagacggagtctgattctgtcacccaggctggagtgc

SEQ ID NO: 68222 - DNA, 201 bp, Homo sapiens
aatatgcagaatgggagaaaatatttgcaaaccatatatctggtaagggattaatatccaacatgtataaggaacttctacaattcagtggcaaaacaaagaaacacacaaaaaaccaaatagcctgataaaaaaattaagtaaaggacctaaatagacatttcaccaaagaagacatacaaatgaccaacaggtatagga

SEQ ID NO: 68223 - DNA, 201 bp, Homo sapiens
tgttatatatatgatttttatatgccatgtatatatgtgtatatatatgtgtacacacacacacacacacattcacacacacacgaccatggatagatttkttttttcttgagacggagtctgattctgtcacccaggctggagtgcagtggtacaatcttggctcactgcaacctccgccccccgggttcaagcgattct

SEQ ID NO: 68224 - DNA, 201 bp, Homo sapiens
aaaataattccttcatttttctcctcctcccttcctcccagagtatggggtaataaacttgttctgagccataggtagctgactgtaaacacacacagatmcacacacacacacacacacacacacacgcctattctcacaaactggaataacgcgggataaccaccccatggtaactgagcatttctaagaagacacacc

SEQ ID NO: 68225 - DNA, 201 bp, Homo sapiens
agcagcagggatgggagatcatgtatgtgtacgggggagaagggaattcagagctgctggcagtgctggtctgggctatattggtgtttgttttattcattgtgtgtgtgtgtgtgtgtgtgtgtaaaatggatttttctgcatgttcacaataaaatttaaaaagacacaaaatacatatattaaataggttggtcaggt

SEQ ID NO: 68226 - DNA, 201 bp, Homo sapiens
gcagcagggatgggagatcatgtatgtgtacgggggagaagggaattcagagctgctggcagtgctggtctgggctatattggtgtttgttttattcattgtgtgtgtgtgtgtgtgtgtgtgtaaaatggatttttctgcatgttcacaataaaatttaaaaagacacaaaatacatatattaaataggttggtcaggta

SEQ ID NO: 68227 - DNA, 201 bp, Homo sapiens
cagcagggatgggagatcatgtatgtgtacgggggagaagggaattcagagctgctggcagtgctggtctgggctatattggtgtttgttttattcattgkgtgtgtgtgtgtgtgtgtgtgtaaaatggatttttctgcatgttcacaataaaatttaaaaagacacaaaatacatatattaaataggttggtcaggtaa

SEQ ID NO: 68228 - DNA, 201 bp, Homo sapiens
gatcaccaagagaatgagagtagatagagaaaatttccaaggaccaagtcccgggacactgctatgctgaagtttgggagcatgaggaggagacagaaaaragaattgaaaagggataggggagaatagagagtcccagaagtcaagaaagcatttcaaaggggcaggacaatcaattgtattagatgccactgataagtc

SEQ ID NO: 68229 - DNA, 201 bp, Homo sapiens
acccattaacttgtcatttacattaggtatttctcctaatgctatccctccccctgccccccaccccctgacaggccccaatgtgtgatgttcctcgcccygtgtccaagtgttctcattgttcagttccaacctatgagtgagaacatgtggtgtttggttttctgcccttgtgatagtttgctcagaatgatggtttcc

SEQ ID NO: 68230 - DNA, 201 bp, Homo sapiens
tgggatcactaggtcaaatggtatttctagttctagatccttgaggaatcgccacactgtcttccacaatcgttgaactagttcacgctcccaccaacagygtaaaagtgttcctatttctccgcatcctctccagcatctgttgtttcctgacttttaatgatcgccattctaactggtgtgggatggtatctcattgtg

SEQ ID NO: 68231 - DNA, 201 bp, Homo sapiens
cacaatcgttgaactagttcacgctcccaccaacagtgtaaaagtgttcctatttctccgcatcctctccagcatctgttgtttcctgacttttaatgatygccattctaactggtgtgggatggtatctcattgtggttttgatttgcatttctctgatgaccagtgatgatgagcattttttcatgtgtctgttggctg

SEQ ID NO: 68232 - DNA, 201 bp, Homo sapiens
aatgtcaagtagactggtgggttcatgagattggaaaccaatgagctggaagaatatgattcactttgcttttctgtggttcccatcccatgaactggggcaaatcatataactggcaaatggggtttcttggctattttagggtcattgggaatctatttccagtgctatgaactcctgtaaggcatttctctctgcttc

SEQ ID NO: 68233 - DNA, 201 bp, Homo sapiens
tgctgatcaccatgagaatggcaccaagacattcctgagggatctgcccctatgacttatacacctcccaccaggctctacctccaacattagggatcaatttttttttttttttttgagacagagtctcgctctgtcgcccaggctggagtacagtggcgcgatctctgctcactgcaagctctgcctcccaggttcatg

SEQ ID NO: 68234 - DNA, 201 bp, Homo sapiens
ctttggaggagaagaggtactctgatttttagaattttcagcttttctggtctggtttctcctcatctttgtggttttatctacctttggtctttgatgayggtgacgtacagatggggttttggtgtggatgtcctttctgtttgttagttttccttctaacagtcagaaccctcagctgcaggtctgttggactttgct

SEQ ID NO: 68235 - DNA, 201 bp, Homo sapiens
tttctcccagtctgtggcttgtttttactatgactgtggtatcatatgttgaatcaaattgatattcttttgatttttttaatggaatttacttgtaaaamatgggcttgatatgcattctgcagcagtcagtgtagtgttattggttttttagatcaagtttgctaattgtggtttcacatcttctgtatacctgctgat

SEQ ID NO: 68236 - DNA, 201 bp, Homo sapiens
agttcacccaatctccctgacaatgcctagaatggtgttttgtacattgcagataccttagttgggactggtgcttttgcaggattagaaattcactccarcttactcaaataacaagagatttattttaagaaagcaagagacaagctcctgggtgtaggaaatgaaatataaccaggcctcttgggaactggagctaga

SEQ ID NO: 68237 - DNA, 201 bp, Homo sapiens
caccaacagtgtaaaagtgttcctatttctccgcatcctctccagcatctgttgtttcctgacttttaatgatcgccattctaactggtgtgggatggtayctcattgtggttttgatttgcatttctctgatgaccagtgatgatgagcattttttcatgtgtctgttggctgcataaatgtcttcttttgagaagtgtc

SEQ ID NO: 68238 - DNA, 201 bp, Homo sapiens
cttcatgtccctcccacaagaccctaaacaaaggatgtttttgccattgttttttttcccctagtccgtctcccaatcccaaccccaaatacacacacacrtacacacacacacacacacacattcactcactcctcaataccctcacctccccagcctcatcaatactttcatcactggtcttcactgcaaaagtgattt

SEQ ID NO: 68239 - DNA, 201 bp, Homo sapiens
tcatgtccctcccacaagaccctaaacaaaggatgtttttgccattgttttttttcccctagtccgtctcccaatcccaaccccaaatacacacacacgtmcacacacacacacacacacattcactcactcctcaataccctcacctccccagcctcatcaatactttcatcactggtcttcactgcaaaagtgattttt

SEQ ID NO: 68240 - DNA, 201 bp, Homo sapiens
actgcccaagccagaggcccccacttcccctcccctttcctcctgtgcctctcctcccctcctcttaccccctccttcctgcctccctccctgtgcatgcktgtgtgtgtgtgtgtgtgtgtgtgtgtgtgtgtgtgtgtgtgtagtccagcacagcttattttttcagggagccttccacctgctgttttctctccctac

SEQ ID NO: 68241 - DNA, 201 bp, Homo sapiens
ctgcccaagccagaggcccccacttcccctcccctttcctcctgtgcctctcctcccctcctcttaccccctccttcctgcctccctccctgtgcatgcgtgtgtgtgtgtgtgtgtgtgtgtgtgtgtgtgtgtgtgtgtgtagtccagcacagcttattttttcagggagccttccacctgctgttttctctccctacg

SEQ ID NO: 68242 - DNA, 201 bp, Homo sapiens
tgccaggggagcccggtgccggggctctacgtccagggcacatccagggcacgatggagtgggaaactgtgctgacggagttgaccagaacgtgttttttkttttgttttgttttgctttttgatggaaaatctaaaatgccaggctgaggactccgatttttttcatagacaatggaaaagtgtttgctggagttcccag

SEQ ID NO: 68243 - DNA, 201 bp, Homo sapiens
aacagtaaaggcaaagcctgcagaccaaggctaagcttggagactcttatccacactattcattggatgctgatcaggtactgtctgatcttaccgcatcrcacatatatgtgtgttcccagtgttagaatagactaggctctgctggggtaataaattcatctcaatatcttggttgcatcacataaagtcatctgtgtt

SEQ ID NO: 68244 - DNA, 201 bp, Homo sapiens
attgcctttctttctggcttataaggggtggaagagaagcatgagtgactagaatcggcttatattcctccagaaggttgtttcctcattaaaaaaaaaaragagagagagagaaagggagaacaggactggatttggaatcgtaggtgttttcattgatccttcaccctcagattatcttttgtatggtcatttcttttg

SEQ ID NO: 68245 - DNA, 201 bp, Homo sapiens
gtgcattgatgcacaccctgcttaccctatatctcacacacatgcacacacttgtacacatgcatgcatgcacatgtgcacgcacgcgtgcgcgcgcgcgcacacacacacacacacactctctgcttaccctgtaccaaacactgttctaagcactttacatatatcagtatgtttaatccttaaaacagccccaggagg

SEQ ID NO: 68246 - DNA, 201 bp, Homo sapiens
tgcattgatgcacaccctgcttaccctatatctcacacacatgcacacacttgtacacatgcatgcatgcacatgtgcacgcacgcgtgcgcgcgcgcgcacacacacacacacacactctctgcttaccctgtaccaaacactgttctaagcactttacatatatcagtatgtttaatccttaaaacagccccaggaggg

SEQ ID NO: 68247 - DNA, 201 bp, Homo sapiens
tcaaaaccaattgtgcaatgtgtcacaagtaatgcactactgccaatgttttagaaatacaaggtaaaacagagtcagtgccaccctcactttcttagatktctagatgttttttgaggaagggacgtttcagcatacacaaatggaagtgcaggtcatcatttttcattgagtgtcttgacaggaataataagtttcaga

SEQ ID NO: 68248 - DNA, 201 bp, Homo sapiens
tggcatgatggtgtgggtaatgggggtatagggggaaggccagcagtggatgagtgttgggagatgaagtggtccagacgggtaggtgcggactcgatcawgaaagaccctgtatgtcatatatgacaatttggtcttcatcctaagaagagtaggcaaccacagagtgggactaacttggtgagattgtttcaaaatggt

SEQ ID NO: 68249 - DNA, 201 bp, Homo sapiens
tttccaccctacccatggcactaccagggcaacagcatgacaccaggtacccagacagtccctccacccaccccccattcccaaatgaagggcagcccagwtggttgtgctgtcagcaaacattgctgtttgcaaaggcatgacctgccttagggagaggtaaggggaagagcaggcacttttgcttgggcatcttcttgt

SEQ ID NO: 68250 - DNA, 201 bp, Homo sapiens
taggaggtgtggtgtatgggaggtgatgaggccatgagggcagagcacacatacatgggaaagagtcctatgtaagaggcctgagagagatgcctttcccyttgaccatgagaggacagtgagaaggtgctgtctataagccaaaagacaggccctcaccagacaccaaatctaccttgatctcagacttgcaaacctcca

SEQ ID NO: 68251 - DNA, 201 bp, Homo sapiens
gggggagttggtcaggaaaggtatttcaaggtggtagctttatagctgagacccagatggcaggagggagcaacccacaaaaagatctagaaggagaactyttaggaagatggaacagtaaaggcaaagcctgcagaccaaggctaagcttggagactcttatccacactattcattggatgctgatcaggtactgtctga

SEQ ID NO: 68252 - DNA, 201 bp, Homo sapiens
cattgctggttggttatgccagtctgtctctatttttagaaagagctacaagagggaggaaaagaatctagagaaataagtacagatggattcctccctgrggcagaagctggggtctgtgggatgaagcacagacacaaagccattgtcctgccacccagcagtggagtcggagatggatggcatgaatctagaatacca

SEQ ID NO: 68253 - DNA, 201 bp, Homo sapiens
gccactctgctgctcgtccctttctaagatgctaagaggatgtggcctatgggagaaggggagccgtctaaggaaattgcccccatgctggaagtgggaayggcagggaagagggccctattttccattgaagaaaagccgggacaaatgcttcttttctctttcccaggaatgaagcaccttttgaaaggtgtaaatcct

SEQ ID NO: 68254 - DNA, 201 bp, Homo sapiens
gatgtttttgagcaagactttgaaggctcgctcaaagacaagtagagttgctgagaagaagttgtactctgtggaggactgacatttctagatggacagcygctcactttcagccaagaccacttgtcctcccactgcccccagagaagggcagctccccacagagtgtccgaggtccatgcactgacttcttgtactcat

SEQ ID NO: 68255 - DNA, 201 bp, Homo sapiens
tacctctctgatcttccctcctgcttatcttgtccaaactgcaggtttgttttcacaaccttccattcattgaaatgccactctgctgctcgtccctttcwaagatgctaagaggatgtggcctatgggagaaggggagccgtctaaggaaattgcccccatgctggaagtgggaacggcagggaagagggccctattttc

SEQ ID NO: 68256 - DNA, 201 bp, Homo sapiens
gtggcctctagagtaaaggcccctccagccttctcttaacatgtccccacactttcactgggattaatcgctcccctgtgtgcttctgtggtccttaaatrtacctctattttatgatgagtgacagccaactatggtttgtggcactccttaacagtaggagtctgtttcccctcattgagggagggaattgagtcagct

SEQ ID NO: 68257 - DNA, 201 bp, Homo sapiens
atggctagttggggtgggtttcctaggtgaagtgatgtttttgagcaagactttgaaggctcgctcaaagacaagtagagttgctgagaagaagttgtackctgtggaggactgacatttctagatggacagccgctcactttcagccaagaccacttgtcctcccactgcccccagagaagggcagctccccacagagtg

SEQ ID NO: 68258 - DNA, 201 bp, Homo sapiens
gagagggagacaaggagagggaccatgtctgagtgatggtgtcattggagtgacacagatgggctcagataacagaaagcttcaaagaggagcaaagatayatttttgtgtcaagatgcaaagaacatgaacaagtagagatggggggctaatggcaaatgtaggtttcatacttctatgaaacatatcactgaaaggact

SEQ ID NO: 68259 - DNA, 201 bp, Homo sapiens
tggtgtccttgggtgggcgcttgctgcctgctttggtgccacatgcccgcttcccagaggggcccatggaggggatggtggcctctagagtaaaggccccyccagccttctcttaacatgtccccacactttcactgggattaatcgctcccctgtgtgcttctgtggtccttaaatatacctctattttatgatgagtga

SEQ ID NO: 68260 - DNA, 201 bp, Homo sapiens
gtcccctcggagaatgggtgaggatagaatggcaccgcctgcagttgttttagttatgcttgttagtcacttacatggtctgtcctctcctgcatcatggygtgtcttgggaaagccagagacaggtcaaaagcctggcccgttgacctttggaatctctgacatatggacagggataaggacatgtgtgttccctgaatg

SEQ ID NO: 68261 - DNA, 201 bp, Homo sapiens
atcctggtgggtgacgaggggaagtgtacctgtgattcttggcctgagagcccatggacagaagtctgctgcccttgtatctttgctgtttgtttaaagtrgatagcattcatgctcttccccccttttctttctctccttttttcttctttctctttcaattttttcttcttttttctcctctcttgccatgagcagatg

SEQ ID NO: 68262 - DNA, 201 bp, Homo sapiens
acaaacaagggaaccattataaggctactagtggacttctcagcagaaaccttgcaggtgaggagagagtaggatgatatattcaaagtattgaaatttawaaaacctgccaaccaagagtactatatctaggtcaaagaataaatcaaaaaaggaaattagaaaatatctcaagacaaatgaaaatgaaagcacaacata

SEQ ID NO: 68263 - DNA, 201 bp, Homo sapiens
cctggtgggtgacgaggggaagtgtacctgtgattcttggcctgagagcccatggacagaagtctgctgcccttgtatctttgctgtttgtttaaagtggrtagcattcatgctcttccccccttttctttctctccttttttcttctttctctttcaattttttcttcttttttctcctctcttgccatgagcagatgag

SEQ ID NO: 68264 - DNA, 201 bp, Homo sapiens
catttctgtgcactaacaacctatctaaaaagaaaactaagaagaaaagtaccattcacaatagcaccaaaaagaataaaatacctaggaataagtttaaytaagagggtgaaagatttgcacattgaaaactataaaacgttgataaaagaaattaaagaggatataaataaaaggaaggtgtgaaaggaaaataaaaac

SEQ ID NO: 68265 - DNA, 201 bp, Homo sapiens
atactgaatacaaaggaagctgttgtttctgcttctctggcaggagaataggaagtgaccactggcttgagaagggctgtgctaccaaagtaaaccatcaygggactggttctgaaatgatccaattccctgtctctttaggatgaatctctttaatccaagtaccattaaaatggaatgtagtgatcattcagattcaac

SEQ ID NO: 68266 - DNA, 201 bp, Homo sapiens
cacttagtgagttactttcttctctgattgtcagagtgaaaggtgagtaagatcacttctctcagggagctcacagtcatatgcactgagtcacatgacayagagtggagagtgatgagcgtaatggcaacagcatgaaccaagtactgagggtgcatggaggaaggttgtttaactcctagcttctgtcttcattaagaa

SEQ ID NO: 68267 - DNA, 201 bp, Homo sapiens
agaagaaaagtaccattcacaatagcaccaaaaagaataaaatacctaggaataagtttaactaagagggtgaaagatttgcacattgaaaactataaaaygttgataaaagaaattaaagaggatataaataaaaggaaggtgtgaaaggaaaataaaaacttgggaccccaattcactctgccaaaatgaaaaaattaa

SEQ ID NO: 68268 - DNA, 201 bp, Homo sapiens
catttgcttttggggtcttagtatgaattctttgcctaagccaatgtccagaagagttttctgatattatattctagaaatgttatggtttcttagatttmagtctttgatccatcttgagttgatttttggatatacttgttttctttcagtctacttagaataaatattttaccacttcaaatgcagtaaagaagcctt

SEQ ID NO: 68269 - DNA, 201 bp, Homo sapiens
tagaagctgactactaggtttaatcttttcatgaactaggagtcttcattaggtcaatgtaccagattaggaatgaccacaccaggagaggtgccatctayttatctattaatcaatattaacactgaagttttaggccaactgtaaagagctaaccaactgtgaagtgtgggaacttgatctacacttctgacagcaatt

SEQ ID NO: 68270 - DNA, 201 bp, Homo sapiens
cattgatgcacaccctgcttaccctatatctcacacacatgcacacacttgtacacatgcatgcatgcacatgtgcacgcacgcgtgcgcgcgcgcgcacrcacacacacacacactctctgcttaccctgtaccaaacactgttctaagcactttacatatatcagtatgtttaatccttaaaacagccccaggagggta

SEQ ID NO: 68271 - DNA, 201 bp, Homo sapiens
gaattctccctcttggttcttcctgggcatcagccatgccatttcctctccttgtctcttcactgctgtgagtaagggcttcattagagtcgcttcctttgaaccatccaaggggaattgtttcctgctgcaatcctcagtggtagaggggtcaggccaacatccgaagttaaacatggagatgcctgggtagaacctgcc

SEQ ID NO: 68272 - DNA, 201 bp, Homo sapiens
gtgcccttggctgactcctgatttgcactaaaacttgcagcatttagtgcttacatgttcaaaaatccttctggaaagctaggaggaactggaagccgtgrtctacatgctctgtcctcttttaacagaaaaggtgtattccataagtaacctccagtaaaaagagaaagaatagttgctatttattgggttcctctgatg

SEQ ID NO: 68273 - DNA, 201 bp, Homo sapiens
acaacacactcacaatttgtctgtctgcttccacttctgtctctgtgccgcactcccccccacaccattcactttctgtgattttttaaaaatttaatttygtcacatccttcccctgttcagaaatctacaacagcttcccgttgtacttcctgtggctcacagagccacacatttactctccggccttcctctccaatt

SEQ ID NO: 68274 - DNA, 201 bp, Homo sapiens
cctgttcagaaatctacaacagcttcccgttgtacttcctgtggctcacagagccacacatttactctccggccttcctctccaattccccctcccagtayttccaccaggctcaggatgcttcgcttgtgtggactggccagttccttgcacagccttggggctctccatcaagactttgcccaggctgatgcgtccccc

SEQ ID NO: 68275 - DNA, 201 bp, Homo sapiens
acagcttcccgttgtacttcctgtggctcacagagccacacatttactctccggccttcctctccaattccccctcccagtacttccaccaggctcaggaygcttcgcttgtgtggactggccagttccttgcacagccttggggctctccatcaagactttgcccaggctgatgcgtccccctagagctctccccagccc

SEQ ID NO: 68276 - DNA, 201 bp, Homo sapiens
aaaaatacaaaattagccgggtgtggttgtgtgcgcctgtagtcccagctacttgggaggctgaggcaggagaattgcttgaaccctggaggtggagggtrcagtgagcagagaccatgccactgcactccagcctggcaacagagcaagactctgtctcaaaaaaaaaaaaaaaaagcagagaagtttgttccaggatgt

SEQ ID NO: 68277 - DNA, 201 bp, Homo sapiens
gaattgcttgagcctggaaggcagaggtttcggtgagccgagatcatgccacagcactccagcctgggcgacagagtgagactctgtctcaaaaaaaaaaraaagaaagaaaaaaaagatgagggagctttgaactggggcccagcatggggggaggtgagccacagccacacctagagggattcaagcaaactcctctgt

SEQ ID NO: 68278 - DNA, 201 bp, Homo sapiens
taatacataattatctctcctttgtaaaatcttccctttcccagccccacccaactccaaatcttgatataaatgcaagattctgtatcagaaccaataastaattgagaatctcactatgcctggggtcccacaactgccaccagcaagttccgggaactgaaccatgtgggcaggagctgggagcagagtggtgggaat

SEQ ID NO: 68279 - DNA, 201 bp, Homo sapiens
atatttatataagtatttatataagtaatataaatttgtatatataaatatatttatataagtatgtgtaatatatacttaaaaaataaaatataatatamatatatatatttatattatatataacataaatatttatatataatatatttatatttatctataatataaatatattatagataaatatacttatatata

SEQ ID NO: 68280 - DNA, 201 bp, Homo sapiens
agggaatgtcatgtccctccctttccagggtgccatgaacatagggcagtaggagtgaggaggacagggtgccatggggactgatgttatggaagaggggracttgagctgggtcaggataggatgagggtagaagctggaggatagcacaggagagagggacaacgtgcgcaagtcgagtatggagatgacggtgagggg

SEQ ID NO: 68281 - DNA, 201 bp, Homo sapiens
ccagctgtttgggaggctgaggcaggagaatggcgtgaacccgggaggcagagcttgcagtgagccgagattgcacgactgcactccagcctgggggacasagcaagactctgtctcgaaaaaaaaaaaagaaaaaagtagccgggcgtggtggcaagcacctgtagtcccagctactggggaggctgaggcaggagaatg

SEQ ID NO: 68282 - DNA, 201 bp, Homo sapiens
tgagacaggaggattgcttgaggccaggagctcaagatgagcctgagcaacataatgagaccctgtctctacaaaaaggaaaaagaaaagaaaagaaaagaaaaaaaaacagtagagtgtagtgttgtacacctatagtcctagctacttgggaggctgaggtgggaggattgcttgagcccaggagtctgaggctgcagt

SEQ ID NO: 68283 - DNA, 201 bp, Homo sapiens
tgaacctgggaggcagagctggcagtgagccgagactgcgccactgcactccagcctgggtggcagagtgagactccgtctcaaaaaaaaaaaaaaaaaarggaagtggtgagaatggacttccttgctttgtttttgaccataggagaaaaaaatttagtttttcaccattaagtcactgtaagtctcatgttagctgta

SEQ ID NO: 68284 - DNA, 201 bp, Homo sapiens
gccagaccattcatttgttatttcagtaaatatttactggaagttcaccagtctgtcctccaggaagtggatcagtagatcttgccaactcaagtctccctagctttgatgtgggacgggagaaagagcagggactgagtctcctttaaacacaaagaaatgaagaaaactcggagccaaatgtgccttactgatctgtcc

SEQ ID NO: 68285 - DNA, 201 bp, Homo sapiens
ccttctcctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagcctcggagctaaggctgggcagattcaggatggta

SEQ ID NO: 68286 - DNA, 201 bp, Homo sapiens
tacaatcgacacttgcaattctttttatgccagacgttgtcagcccaaagcatagttggcttcccttgctcttgggaaaaggggatccctgggcacagtcrtaaaatatgggctgaggaaataaatagttatgaccttcccctgctgtgctcttacataagtatgtactaatgggctgtttctagcggaatctttcactta

SEQ ID NO: 68287 - DNA, 201 bp, Homo sapiens
gcagaacataaaagtttggaaaatttgcagcctgactatatgatagaaaagaaaaacccatttttctggggagaaattcaagctggctgcagaaatttgcrtaagtagcaaggagcctaatgttaatccccaagaccatggggaaaatgtctccaggccatgtcagggaccttcacagcagcttctcccatcacagaccca

SEQ ID NO: 68288 - DNA, 201 bp, Homo sapiens
ttgctgcaggggtggggccctcatggagaacctctgctagggcagtgtgcaggggaaatgtggggttgaagcttccacacagagtccctactggggcactrcctagtggagctatgagaagagggccaccctcctccagaacccagaatagtagatccactgacagcttgcgctgtgtgcctggaaaagctgcagacactc

SEQ ID NO: 68289 - DNA, 201 bp, Homo sapiens
ttctacaaatgtattatatgctgaagagtccctcttccccacccccacacccaatctttttgttcttttgatctaagcgtgaaaaacctcaaaaatagcaytcatccttttcagatcagatcctggacattctgaataagtaatcttctattgtagtgagctccccaattctggaaatgatcaaatagaccactatttgtc

SEQ ID NO: 68290 - DNA, 201 bp, Homo sapiens
cttccaatgacaggattgttataaaaacagcattcttttatgcccacccatttaaaagctatgctattataaaaagtaaagaacgagttgctctcaccagkgcgcatggtgggtatgtgacctgttgagctgtgaatgactggttggtgatgctgcagaagccacatgggcggggtggatgcagattctaatagatattat

SEQ ID NO: 68291 - DNA, 201 bp, Homo sapiens
tctagaataccatgggaatgggtccttgccctgggccagtaaacatttgagactcagagccaggagataggatgagaagattgcagtgatgagacccacaragggcagcagccatctcttaaggggtcaacttggagaccaaatccatcacttcttggaggtccagtagcccctgcaccctctgcgctttgcagagacatc

SEQ ID NO: 68292 - DNA, 201 bp, Homo sapiens
tctacctgccactggcctcagtgaattctaatagtgtctaggccatgccctgcatgcctccttacatagagagggatctaagtgaggctggttaaatgctrccaagattgttttcagaactgaggtcctgatagcacctgataggagacacactggttgaacaaacaattaaagagcttgcactatgtatctgacactatg

SEQ ID NO: 68293 - DNA, 201 bp, Homo sapiens
cactcccatcttgcaggtggataacgtaaacaagagtgagaaagccagaccattcatttgttatttcagtaaatatttactggaagttcaccagtctgtcstccaggaagtggatcagtagatcttgccaactcaagtctccctagctttgatgtgggacgggagaaagagcagggactgagtctcctttaaacacaaaga

SEQ ID NO: 68294 - DNA, 201 bp, Homo sapiens
gagaacccaaaggccagatttccagtgggttgacttctgcccatgaagaccaagtgccctctaagctctttggtgaacttaccaatcttatttagaagataaaaaaaaaaatgaggaatgtgataactccatgaggccccaagataatatggaggcctgagccacagggtaaatttagattttattgcctttctttctggc

SEQ ID NO: 68295 - DNA, 201 bp, Homo sapiens
tttagattttattgcctttctttctggcttataaggggtggaagagaagcatgagtgactagaatcggcttatattcctccagaaggttgtttcctcattaaaaaaaaaaaagagagagagagaaagggagaacaggactggatttggaatcgtaggtgttttcattgatccttcaccctcagattatcttttgtatggtc

SEQ ID NO: 68296 - DNA, 201 bp, Homo sapiens
atggaggcgatatgtttgaatgatcgctcagacatcccctgctgccccacccccaggagtctcctcactttcccgtatgtcacatgtcacatttcactcayacaggaaggagtggattcagaggaagagtgtgtgacttggtgaagcagctcccaagcacccaagatgcccaggagcctctggaagcagcagttggtcccc

SEQ ID NO: 68297 - DNA, 201 bp, Homo sapiens
agattagaaaagttggaagttctctaacaggtgcacacatcctgttagctagtaattaggtttaagaatgaaataaattattattgtttatttcaatttaygcatattttccccaatggctattaatttgttaggacataaatatttattaagttatttggacttaactacttaacacatggaactgttaagtatttcttt

SEQ ID NO: 68298 - DNA, 201 bp, Homo sapiens
ccgccagccctcacatggtcactggattggttcgagtgggctctaaggcaactgccgtgtgccagtctgttgacatgatcaacattaatattcttgcggcggggggggggtgttcattaaattaaggaatgacacagggagccaagagaatggcttatttgtttggattctgaatcacaatcgggaaatagtctttatctg

SEQ ID NO: 68299 - DNA, 201 bp, Homo sapiens
ggttttagaatgctagtctaacatctgttttcgtttccttgttaattccattcatccccacaccctcctggccttatccccattcctgactccaaagtgawttcctcagcaaagctttatttaaaagatgagagagatcctgcattttgaactggcttccagagcttgtttttggggatttctccaccaccctccaatcgt

SEQ ID NO: 68300 - DNA, 201 bp, Homo sapiens
ggggatttctccaccaccctccaatcgttgttggccagccagctagtcaggtgatcactctaaggtcccaaccttgacaaatctgtgtatttcggtgcagktgtcttgctaccgaccagcacttgccggcctcctagggcctgcaggaacctactgggcaccaaggacaatggcagtggacagggttgaatcagcaagaac

SEQ ID NO: 68301 - DNA, 201 bp, Homo sapiens
actttctcaccctgttccttcccttccttgacgttaccactgctcttaacgttgtgtttaccattttcatatttttgtacttatattgtgcatacatacastaaatactgtatgatatttttgcagtttgtaaacttcatctaaattgtattatactatacatattatttagcattttgctctttttcttaatgttgtttc

SEQ ID NO: 68302 - DNA, 201 bp, Homo sapiens
gtgagaaggcaggaccatggtcgttgctggggagatgctaggagatgaagctagggaggcagattggaggcagattataaagcacctgtatgcaccggtagggactttggattatattcagtgaacagagtggagccaacaggaatttttataagcaggtagataacagaatcaggtgagaggggctgtgtgctggataga

SEQ ID NO: 68303 - DNA, 201 bp, Homo sapiens
cagtgccagtccatgaaagcagccaggagggaggctgtaccctgcaaagccacaggggtgcagctgcccaagaccatgggaaccaacatcttgcatcagcrtgacccagagtcaaaggagatcattttggagctttaaaattttactgccctgcttgatttcagatgtgcattggccctgtaacccctttgttttggtcaa

SEQ ID NO: 68304 - DNA, 201 bp, Homo sapiens
gagagatagtattgattttaatctttctgtcattttattgaattcatttcagatctagatttttcctggctcatttttctcttcagaataaacttcttgcycctgttggtattgggaagtgctagtcacctaggcaacatgcgtacagagccattggcgtctactgttccttaagcagagctttgaccagtcaccaccccc

SEQ ID NO: 68305 - DNA, 201 bp, Homo sapiens
catcctgggagaatggtgacaagaaaccccgtcaggaggctgttgcaatggtccaggtagggctggactctttccagctgtctcatgggcatgggctgtgccaccatgcttttgctcacactgcttccatagcttagaaggtctctttgacttaatcctcaagaaaactgcatgcccatctttccagactgtgctgaggga

SEQ ID NO: 68306 - DNA, 201 bp, Homo sapiens
cctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaa

SEQ ID NO: 68307 - DNA, 201 bp, Homo sapiens
aagttccgtatgattgccaggaactgtggtgagaaataaggcaaatgggtgctactcagccaaaacaaccaatgcccaggacaccaggtattgtgaatatrtgtggatcagattgagctttcttgtatctgccttcagagtcactggattttccggccagctataaggctctgatagttgtctccccattattcccatgca

SEQ ID NO: 68308 - DNA, 201 bp, Homo sapiens
ttgtttgtggcccgttttagaaaaaaatctgacaccgagtggcagaattatcagtgggcacatgcatagaaagtgcactttcattctatatttctgccaaraaaatttatttgcagaaaataaatcatcccaagatcaagctgaagtgactttgaagcatccatcatttttccttcctctctcagtaccagtgaggattac

SEQ ID NO: 68309 - DNA, 201 bp, Homo sapiens
ctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaat

SEQ ID NO: 68310 - DNA, 201 bp, Homo sapiens
gaggacatctgagccctgagtctctctcctctctgtacctcagttttttcatctgtaaaaatggagactttggaataaaaaatcttcaaagattcttttcttttttttttttaaacttcaggtttaatggcatgtcatttattaatctagttctacaaaaattctaaacattacaggtaaccactccacctctgttttgcc

SEQ ID NO: 68311 - DNA, 201 bp, Homo sapiens
tttgcttgtttgtaaaggattttatgtctccttcccttatgaagcttagtttggctggatatgaaattctgggttgaaaattcttttctttaagaatgttraatattggcccccactctcttctggcttgtagagtttctgctgagagatctgctgttagtctgatgggcttccctttgtgggtaacccaacctttctctc

SEQ ID NO: 68312 - DNA, 201 bp, Homo sapiens
tctgaccatggagtcacactgacctaggctcaaattccatcttctcagttacattcattcatccatccatctattcattcattcagcttgtattgatggarggtcaggaactgttgtaggtttggggaacacaacaggcaacccccctattctatggagctttcattccagtaaggctgcagagtgaccttgggcaactcg

SEQ ID NO: 68313 - DNA, 201 bp, Homo sapiens
tctctgtacctcagttttttcatctgtaaaaatggagactttggaataaaaaatcttcaaagattcttttcttttttttttttaaacttcaggtttaatgrcatgtcatttattaatctagttctacaaaaattctaaacattacaggtaaccactccacctctgttttgcctccaccctaacccctgcccaaccccaggc

SEQ ID NO: 68314 - DNA, 201 bp, Homo sapiens
caggtacaccaatcagatgtagatttggtcttttcacatagtcccatatttcttggaggctttgtttctttttactcttttttctctaaacttctcttctyacttcatttcattcatttgatcttcaatcactgataccctgtcttccagttgatcgaatcagctactgaagcttgtgcatgtgtcacatagttctcgtgc

SEQ ID NO: 68315 - DNA, 201 bp, Homo sapiens
acaggtaaccactccacctctgttttgcctccaccctaacccctgcccaaccccaggcatccttccaacagtaatagggtgatacttacgggtgaatgttytctaggcatttttctatgcattaacatagtattaacttgtaggacttttaaggtattgtttcatgggtttgttttataatgaaatatattttgagttaat

SEQ ID NO: 68316 - DNA, 201 bp, Homo sapiens
gctgcagtgatctgtcttcctgccttcatctgtggaatttgctttattccacctaccaggacctgcaatggtctttttcatttgcttatttctttttttctttttcttcttcttcttcttttttttttttttttttttgagatggagtcttgctctgttgcccaggctggagtgcaatggtgcgatctcggctcactgcaa

SEQ ID NO: 68317 - DNA, 201 bp, Homo sapiens
caaaagctggggtgagttaatagcagaggtggaaccagaattagattatttatggattcttttcagactggaaaaaagaggggtgagcagtggctcgcatmccgaggtcagtgagcagctgttcctgcagagatgcagctagagaacaagagaaatggactttcattgtagcagtagggattgggctgaacccagggaagg

SEQ ID NO: 68318 - DNA, 201 bp, Homo sapiens
gaaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagata

SEQ ID NO: 68319 - DNA, 201 bp, Homo sapiens
gcttcccttggctaggaaagggaattccctgaccccttgcgtttcccgggtgaggggatgcctcgccctgctttggctcatgcttggtgcgctgcacccaytgtcctgcacccactgtctgacaagccccagtgagatgaacccggtacctcagttggaaatgcagaaatcatccgtcttctgcatcgctcatgctgggag

SEQ ID NO: 68320 - DNA, 201 bp, Homo sapiens
aaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagatat

SEQ ID NO: 68321 - DNA, 201 bp, Homo sapiens
actggggaagagacggcagggtggcaggaatgaagaccatgagcatttgagccactttctcatgtaacttacttgtgctttcaggacctgcttgagcccartcacatatataccacttacgtttgatgatggaatgctgctgttcatgacccactttatggttagatgggtcagaaggcacccagttcattataggcagtt

SEQ ID NO: 68322 - DNA, 201 bp, Homo sapiens
gctcttagaaaagggctttccacccagatctactccgttcttccccatgtagaacttctccttctggaggtgagagcatgcacaggtctagccacacactmgtgtttgtttctacttgggaccagtatcacctgtttgtgagacagccagtaggctttacaaaaacagcctagactgaagaatggatgatgaaatccagct

SEQ ID NO: 68323 - DNA, 201 bp, Homo sapiens
tttttggtacttttgagatttgctttgtgacctggaatgtgcttttttttttttttttaagttccatgtgtacttgaaaagaatgctgaccaatgatcttaagattcttttcaacttggtgagtcagtcgttccatatcaatgtcaaataaccctgcctgatctggcatgttgttcaaagtcgtagttaaaagggcctaat

SEQ ID NO: 68324 - DNA, 201 bp, Homo sapiens
cacacacacacgcctattctcacaaactggaataacgcgggataaccaccccatggtaactgagcatttctaagaagacacacccatgagtattagaaaasggaccaagtcaacctgtgtcagcccatctgagtagccacctgctcctttactcatcaccgaatgtgcaggcccttggtttgcacattggatcacagacca

SEQ ID NO: 68325 - DNA, 201 bp, Homo sapiens
cataaattttctcctgaatttgggcatctgcactgagtttagagaatttgtggcaggaaatttgccctggaaatgtactcagctgaatacttgcacttctyagcatggaaagactcccatccaagaatctcagcatgcttgtctataaacatgaatgaattaatcctcctagcaccactgtgtgctctttgccagctgggt

SEQ ID NO: 68326 - DNA, 201 bp, Homo sapiens
aacgaggagcaaagataaagtcacaggaaatatctataattagggattcaaactagaaggaagatggttcctaagtaagtcaggtaaggatcaaacagacrtgaggagtcctcgtgcagtggttacaggcactttgtggggttgagtgggtggatcacttgaggccagcagtctgataacccctttatcattttttattgc

SEQ ID NO: 68327 - DNA, 201 bp, Homo sapiens
gtctgggccagggtattgagggggtctctggatattttgaggactttggattgactccgaatgagatgggaagtcaccagggctctgagcagaagaccacaggatgagtctaatatttctgaatgctcactctggttgcttagtggagactagaccgtgggggcggggacagagtggggagccagtggaggcagttgcagt

SEQ ID NO: 68328 - DNA, 201 bp, Homo sapiens
aatcagccttcccttatagctcttctgaggactagccccccattcccgatgctggtgagccgatgatgggcagtgtgtcgtgcttgctcccatgatctatycccaccataattcctgctcctccaaaagcaaccccactgtcactcagccctcctcccctcttctttcacttccaagctcagcaagcccctctgttctgac

SEQ ID NO: 68329 - DNA, 201 bp, Homo sapiens
tatattccttgcattatacatcccataatgggattgctgggtcaaatggtatttctggttctaggtctttgaggaatcgccacgctgtcttccacaacggytgaagtaatttacattcccatcaaaagtgtaaagcattcctatttcttcctaacctcaccaacatctgttgttttttgactttttaatgatagccattct

SEQ ID NO: 68330 - DNA, 201 bp, Homo sapiens
tcctgcagttcagggaagaaacggagctgaagggcatgtggaagaagaatgtcacggagatgcaaggggttgggttattggttggcttaaggtcaaatcaytatttgctgcctgaagaaaaaaaaaagaccttgcttagggacagaagtccttgtcctggtcttaggtcagatgagggggtaaaggaactcttccaactgt

SEQ ID NO: 68331 - DNA, 201 bp, Homo sapiens
aagtacagatggattcctccctgaggcagaagctggggtctgtgggatgaagcacagacacaaagccattgtcctgccacccagcagtggagtcggagatrgatggcatgaatctagaataccatgggaatgggtccttgccctgggccagtaaacatttgagactcagagccaggagataggatgagaagattgcagtga

SEQ ID NO: 68332 - DNA, 201 bp, Homo sapiens
aacagtgtgcactcctatccctgagtgatctagcactcgccctgaccagtgctttcgaagaggacagtggtggtggtattcccctcagaagacatgtcctygagccaccctgcatgctttctcttcccctaactcttcccacactgtttgatttcaggtttgtgggcaggcctggaagctacgtctatgtattcgatggtt

SEQ ID NO: 68333 - DNA, 201 bp, Homo sapiens
gtttcaggcatgccaatctaccgagtcagttgggaatgcttttcatggggtgatgagagcaaagaaatgccccagtgctatttcatctgcctccttgtgtwagaaaccagcatggacaaagacgaatttcctctccgccaatcctgtgtgttcagctaaagtttcctttttgaatggtccctcctgttttcttcttgtaag

SEQ ID NO: 68334 - DNA, 201 bp, Homo sapiens
agcattttgcaaggataatttcctctactcttcacaacttccccaggggacagggttttacagatgtggaaactgaggcttagagaattgaaataatgatycagaatcaagtgacagagacaggattcaaacccagcaatcataaccactgcagtcaaggtggcccacctgaagtgtgttgggagtggctggaactgacac

SEQ ID NO: 68335 - DNA, 201 bp, Homo sapiens
acccaaggctttcacaccatagtccaatctccttttgaaatcgtggtttattcttcatttttctgccttgtaagtcatgagctttcttcctcaaagtgaggtttggttctggatgtttgaattactgaacatattttggagctgccattgaagaataatagaaatagttttcacttgcattaataagtgccataaaatatc

SEQ ID NO: 68336 - DNA, 201 bp, Homo sapiens
aattctttttatgccagacgttgtcagcccaaagcatagttggcttcccttgctcttgggaaaaggggatccctgggcacagtcgtaaaatatgggctgakgaaataaatagttatgaccttcccctgctgtgctcttacataagtatgtactaatgggctgtttctagcggaatctttcacttactgcctcctgagtgag

SEQ ID NO: 68337 - DNA, 201 bp, Homo sapiens
tatacactgaggttcatctaaggggagctctggaaattcctgtccatggtatctagttagcaccacagaaaataggggtttaagaaagatgctgatgatgygggtagtggtcctgcagggttgacaggtttggctgacagcctgtaagagcacaagtatgcttttcatgttgtgggggtgcagagggaagtggagagagtg

SEQ ID NO: 68338 - DNA, 201 bp, Homo sapiens
ttttggactgttcactgccagtatatagaaatataattgatttttctatattgatctggtatcccataacttttctgaactcatttattagttctaataakttttaatggattccttaggattttctatttgtgagatcatgttatctgtgaatagtgatagttttacttcttttttccaatctggatatattttatccct

SEQ ID NO: 68339 - DNA, 201 bp, Homo sapiens
acctgctcctcactctgccctctcctcatcaccatctcagccctggctgcagtgatctgtcttcctgccttcatctgtggaatttgctttattccacctaycaggacctgcaatggtctttttcatttgcttatttctttttttctttttcttcttcttcttcttttttttttttttttttttgagatggagtcttgctct

SEQ ID NO: 68340 - DNA, 201 bp, Homo sapiens
ctcccatattccccaccctttgcctagccctccagcctgagagagctggggtggaggagtaggagagagagacagacagagagagagagagagagagagaragagaaagagagagatagatagatcagagaatatagtttataactcatcaagagtctataattcaatctagtagaaatgctcatttatctcttaaaatct

SEQ ID NO: 68341 - DNA, 201 bp, Homo sapiens
catacacacatgtgcacacacacatgcatgtgcacacacacacacacacacgagctgactcccttaaaccaggtagctgacctccatgggtccacactctrggtccaaactcaactgaaggaaagtgaactgaaggagacatttgtgaatttgattctccaacctaaggactttgcttttcaaaccaagagtgttcagaag

SEQ ID NO: 68342 - DNA, 201 bp, Homo sapiens
tgaggcaggagaatgacatgaacctgggaggcagagctggcagtgagccgagactgcgccactgcactccagcctgggtggcagagtgagactccgtctcaaaaaaaaaaaaaaaaaaaggaagtggtgagaatggacttccttgctttgtttttgaccataggagaaaaaaatttagtttttcaccattaagtcactgta

SEQ ID NO: 68343 - DNA, 201 bp, Homo sapiens
aagacttctgttaccattaacatagttccccggctccatgagacatgaacagcctctctgagaatgcaccgacaactcagcatgccttgtaaacagaccayaattatagagcttggttttgactttttttccagggccttaaagttgatatatttttacatttcctggattggagggtagggagcatggctttgggtttag

SEQ ID NO: 68344 - DNA, 201 bp, Homo sapiens
gagtccttttgtctgggaccagctcctatctgtcatgcaatttaagctgccctggtttactgaagtcattcgtggaaacaggctcccccaagtgacttccytcagaaaccctgtcctggccctgccaaccctctccatccacagttccctgtggtgtctctgaccacaggcatttggcttcagtcacctcccaatccgtag

SEQ ID NO: 68345 - DNA, 201 bp, Homo sapiens
caggcatttggcttcagtcacctcccaatccgtagatgacctcggcctgctgcaatgtctgggtcccctgtcctgggaaatcaaggcagacaaagtgtccrtgaagacagggatgagaaactgtccattttatttctacctgccactggcctcagtgaattctaatagtgtctaggccatgccctgcatgcctccttacat

SEQ ID NO: 68346 - DNA, 201 bp, Homo sapiens
agcagaatctatctgaaagcaaccggcaaagcgctggcacgaaagtccaggcaataagtctatgtaactttagaacccactagccacaaatcatttacaartggggtccttggttggaggttggagaggctatcggggaagagaaataaaaatttgacaagaagcacaggaatgctcacccctgacataatgaataaatac

SEQ ID NO: 68347 - DNA, 201 bp, Homo sapiens
tgggtagacagaggattcaagattaactgagtttcccttgttttggattcagcagaaaggtctggcaacttgaaatctggaaggtggttggactgccagtktgagtcttggtaacaacagttctataaacaagccaggagttcccagttccccagagcccaccgtgtgtcatcgtccagctttcttccaggaaggtctata

SEQ ID NO: 68348 - DNA, 201 bp, Homo sapiens
gactggaaaagaagcagcctgggggaaagataatgagttcaattttggatgtgttgaatccaggtgtttataaaatatccatgtggagaagtcatttaggmagttgggtccagagctcagaagagaagtctgggccagaaatagaaatttggcattcagatggcactggacacatgggagtggacaatattgggatgtctt

SEQ ID NO: 68349 - DNA, 201 bp, Homo sapiens
tagaaagagctacaagagggaggaaaagaatctagagaaataagtacagatggattcctccctgaggcagaagctggggtctgtgggatgaagcacagacrcaaagccattgtcctgccacccagcagtggagtcggagatggatggcatgaatctagaataccatgggaatgggtccttgccctgggccagtaaacattt

SEQ ID NO: 68350 - DNA, 201 bp, Homo sapiens
ggtcctggctccaggtggggagaagcagtttctctttctggggcaacaaataaaatccctccgagcacaggagtgctcattgctggttggttatgccagtstgtctctatttttagaaagagctacaagagggaggaaaagaatctagagaaataagtacagatggattcctccctgaggcagaagctggggtctgtggga

SEQ ID NO: 68351 - DNA, 201 bp, Homo sapiens
ttgactccctgggtgggggtgggggtggggggtggtgggaccagagtgggaccagggactggaatgtggggcaggctgcagagtggagaggctcgctcagrtgaaggcactactgtgtcaccattggctcctgggtcctggctccaggtggggagaagcagtttctctttctggggcaacaaataaaatccctccgagcac

SEQ ID NO: 68352 - DNA, 201 bp, Homo sapiens
atacagggttcctgggacatttttcgtttttgccttcagggcagtggcagataggtgttctcaagctcaggttttgcctggacatatgacttggggaggartttgctctggaggtcagagcctatgaggcagacagtgacgtcccatagctctcgagggggtgccctgcctgcatctcctgacgcaagcatatctcccttt

SEQ ID NO: 68353 - DNA, 201 bp, Homo sapiens
tggagtcggagatggatggcatgaatctagaataccatgggaatgggtccttgccctgggccagtaaacatttgagactcagagccaggagataggatgaraagattgcagtgatgagacccacagagggcagcagccatctcttaaggggtcaacttggagaccaaatccatcacttcttggaggtccagtagcccctgc

SEQ ID NO: 68354 - DNA, 201 bp, Homo sapiens
ctggcccaagtcccttgctctgccccacgaattagcaggcaatccagggttggaaggaaatgaggctggatgcatgaagggaagctaaggagagatgacaygtgggatcagcaccatggcatttgcacgggtcttatcatttgatggttgggtttagctggaaaacattttgcagcctggaaggaaataatacctcatagg

SEQ ID NO: 68355 - DNA, 201 bp, Homo sapiens
gtgttcatgtgtctttgggttgaatgggaaagctctgtttcaggctgagagttagttggtcctggctctgggctgtggattgtgtttagtttgccccaggygtgcacattttgcttagattcaacagcttctgggacacattctgctcacagagactcagcagagcacaggaaagaaggaaaacatgaagtacttcttgcg

SEQ ID NO: 68356 - DNA, 201 bp, Homo sapiens
ctgagagttagttggtcctggctctgggctgtggattgtgtttagtttgccccaggtgtgcacattttgcttagattcaacagcttctgggacacattctkctcacagagactcagcagagcacaggaaagaaggaaaacatgaagtacttcttgcggtacctgctgacatcacatttgctagcattccattggccaaagc

SEQ ID NO: 68357 - DNA, 201 bp, Homo sapiens
cccgggggaccagcatggggactgctgctccaaatggctttgagttgtcacgtaggggtggtgcatgggaactgtgtctgtgtgcttgtatgtgtgtgtakgtgtgtgtgtgtgtgtgtgtgtacaagaggactggaagggctcccttgtcctgttgccattggatactgccttcaagatttgctcttcatggtaactggg

SEQ ID NO: 68358 - DNA, 201 bp, Homo sapiens
cttatgtttctgtcaaggcttcaccatttttctaagcaatggaggcccatgctgaggatctaaaatagctcgtgccttttcttctcactgtcttttcctakttatgtgtacaatcgacacttgcaattctttttatgccagacgttgtcagcccaaagcatagttggcttcccttgctcttgggaaaaggggatccctggg

SEQ ID NO: 68359 - DNA, 201 bp, Homo sapiens
attagggagtgacttcatcattaactccagccagtcaactgtttctcagcaccaaaatctgcttgaatcactggagaattgactttgccctgctgtgcctrcttgtacagggtctgtggagagccagtttctgcaagtggtctgagacttacacatgtcactgctgctctcacactgcccacatggggcagtcactatagg

SEQ ID NO: 68360 - DNA, 201 bp, Homo sapiens
ggcaaggtgctggagctggcaggttgaggagcagtgctgttctttgcctctcatccctgtaaccattcactcagcactttctcagctcatgcctcctttgmttccaataaactttctattagagtacagtaagaagacaaaactcattctacgtgggtcagcagagacaatacgaagagctaattctaaaggtgttagaag

SEQ ID NO: 68361 - DNA, 201 bp, Homo sapiens
ttgcataagaaacattttatccaccttgctttgggaaacatcctttcccattagaagactcaaagaagggaagtcaaatgcaactatttcttgagtgcttrctatgtgccagacacttggctggggactcaataaggccacatcttaagctgagccacagggaagatcaaagactgtgggagggcagatgtcacttcttaa

SEQ ID NO: 68362 - DNA, 201 bp, Homo sapiens
cataagaaacattttatccaccttgctttgggaaacatcctttcccattagaagactcaaagaagggaagtcaaatgcaactatttcttgagtgcttactrtgtgccagacacttggctggggactcaataaggccacatcttaagctgagccacagggaagatcaaagactgtgggagggcagatgtcacttcttaagcc

SEQ ID NO: 68363 - DNA, 201 bp, Homo sapiens
ctagcagtttggtttgtgcccttccaggtcttttctcatgcatttttattcacgtataaattcatatttgttctgggctctggttgtgggtttatttacgygtgcacacacacacacatacgaaagtcatggacaaatgatttcatcagatcgtggttcccaataacccgagacaccccagggtgccataggaaactcaca

SEQ ID NO: 68364 - DNA, 201 bp, Homo sapiens
agcagtttctctttctggggcaacaaataaaatccctccgagcacaggagtgctcattgctggttggttatgccagtctgtctctatttttagaaagagcyacaagagggaggaaaagaatctagagaaataagtacagatggattcctccctgaggcagaagctggggtctgtgggatgaagcacagacacaaagccatt

SEQ ID NO: 68365 - DNA, 201 bp, Homo sapiens
cttaagcctatccagtgctgtaggcttcccctacaggagtccgtgtccacctacttgtgtgttatgctgggatggaagaaaagcacaccaaattcagagawcctaggtgagtttggaaggaaagatagaacccgtcacagcggtgagccagtgtcagtgagagcttggaagcaggatctcgttcaccaggttaccatcaat

SEQ ID NO: 68366 - DNA, 201 bp, Homo sapiens
ctgcaccctctgcgctttgcagagacatcctgcagttcagggaagaaacggagctgaagggcatgtggaagaagaatgtcacggagatgcaaggggttggrttattggttggcttaaggtcaaatcactatttgctgcctgaagaaaaaaaaaagaccttgcttagggacagaagtccttgtcctggtcttaggtcagatg

SEQ ID NO: 68367 - DNA, 201 bp, Homo sapiens
ggtcctggccacccttaatgctactatcaacaccactgcccatcttggctgcccccgtctccccaccatgcttcattctggtttctgtcagatgttccccrctttggctgggaatttggagggcaaagagatggctcttgcgactgaccagtgttagactggggtcctggattgttgttcctgttgtataaccacccagac

SEQ ID NO: 68368 - DNA, 201 bp, Homo sapiens
aggtcaaagattctgccctcctaattaaactctccctcagatatgtacctgcctcaagttcccttgcttttggtaccaacctctcccttttctcaagaccrttcttcttgaaattcccactttggtttccttacattcctttggcttctttagtaacctcacaatttgtttttttcctcaaatctcctgaaactggtctct

SEQ ID NO: 68369 - DNA, 201 bp, Homo sapiens
actcctcgggtggcccaggccatcagatggggggccctggtccacttcaactgagagttgattcttagcatcaggagttctggctaaaataagaccttctsctctgctcactgtatacatttctactggccagggtctaaattaggaagttacaaataaggagagccctgaggcctgggttatggaagcaaagctatagag

SEQ ID NO: 68370 - DNA, 201 bp, Homo sapiens
caaatccatcacttcttggaggtccagtagcccctgcaccctctgcgctttgcagagacatcctgcagttcagggaagaaacggagctgaagggcatgtgraagaagaatgtcacggagatgcaaggggttgggttattggttggcttaaggtcaaatcactatttgctgcctgaagaaaaaaaaaagaccttgcttaggg

SEQ ID NO: 68371 - DNA, 201 bp, Homo sapiens
gtaaaatttggtaacgaggagcttaaacaatttttttttccttctgggtcatgaaacgtcacacagcagataaataatggcagagctcaggtcgctgtgcrtttcatgagtgcttgtcaaccagtggtgatggtgagccctgactcgggcagtcctgggatacctgcccaaatgaataaggggtgaaagaagaggacacaa

SEQ ID NO: 68372 - DNA, 201 bp, Homo sapiens
ttttcaaggtaaaatttggtaacgaggagcttaaacaatttttttttccttctgggtcatgaaacgtcacacagcagataaataatggcagagctcaggtygctgtgcatttcatgagtgcttgtcaaccagtggtgatggtgagccctgactcgggcagtcctgggatacctgcccaaatgaataaggggtgaaagaaga

SEQ ID NO: 68373 - DNA, 201 bp, Homo sapiens
gcatatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataag

SEQ ID NO: 68374 - DNA, 201 bp, Homo sapiens
catatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataagt

SEQ ID NO: 68375 - DNA, 201 bp, Homo sapiens
cagggtgagatgatctctttcagacttggctctgacctcaactccaaggccacatccctgcctctgcagtgactcccctcctgccctcccccggggcagcrctgtggtgtctgcactgctgccaggcactggggacacagagacaacagacatgcctgttccctccagagtttcagggtctggtgtgagagagagatgtgt

SEQ ID NO: 68376 - DNA, 201 bp, Homo sapiens
ttaacatgactcatacgggcatatgtgaccttttgggttaagatgagacaatggagattgttcttgttttgtagaatttttctctctctctctctctctgygtgtgtgcacgtaattatttctattctcttatccgttagtaatattctagtggtagaaaagggaggtgaaattagcagtggaaagaaaaagtttggaatt

SEQ ID NO: 68377 - DNA, 201 bp, Homo sapiens
tcaactcccatgacagagtcatgtgaatttctataacaaggaatgctagttagccaatttgcgcaagaataatatcaccagcccattcaatagaaagccarcgcttgtgaccgtagctcttcttctacagtcgttttgccttcatgtcaagtgtttgaattttgtaggatgattggttctaataaaaatctgcatatggcc

SEQ ID NO: 68378 - DNA, 201 bp, Homo sapiens
attctatggagatcacttcccagaagctggggtgggtgggggggccagctgctgcaaaggcgctctttggttgaggttaattctttgccccacagccaccraagagtcttcatctgagaacatctaaatggccaacttttggagatcagggggaaaaaaggggtggactaagtaatgagcatagttctgaaaactgtttta

SEQ ID NO: 68379 - DNA, 201 bp, Homo sapiens
caggttttcccacaccagagcttgtgttctgtgatctctgttataccacaaaagataccaataccgactaatatctcatagacaatatccagttatacaattttttttttcaattgaattagttgctaatgtttaaaaattagaagtaaagatttctaacttttcttagcaaattgtaggatgtggcaacgctggtctcat

SEQ ID NO: 68380 - DNA, 201 bp, Homo sapiens
aaagttgtgaccctggaaccatggcaatttgtactcacacttatacaatcctagaagctgactactaggtttaatcttttcatgaactaggagtcttcatkaggtcaatgtaccagattaggaatgaccacaccaggagaggtgccatctacttatctattaatcaatattaacactgaagttttaggccaactgtaaaga

SEQ ID NO: 68381 - DNA, 201 bp, Homo sapiens
tttccagactctttctggtactaattattagtgttggggggaaatacaatttttcctcaaccctcatacatttgtagttgagacagatcaggtaacaggasacaaattaagaagagaaaagcaaggcatgattgataagaaaatttgcttatttctatagtacataccattttaatataataaccaaaattatgactaata

SEQ ID NO: 68382 - DNA, 201 bp, Homo sapiens
agttttcttaattaaagacctaataaaagacaatatgaagcacaataaattattttggtaagacacaagtttttgtttaacttaaaaggcgaagaaaaaattttcgctatctcttatcaatactccaagaaagtcttgacagtttaaaggagaagatcaaattctagttttgtttcagtatacttttgatattaaggctca

SEQ ID NO: 68383 - DNA, 201 bp, Homo sapiens
ttttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgta

SEQ ID NO: 68384 - DNA, 201 bp, Homo sapiens
tttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgtaa

SEQ ID NO: 68385 - DNA, 201 bp, Homo sapiens
ttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgtaag

SEQ ID NO: 68386 - DNA, 201 bp, Homo sapiens
acttttctgacgcacgctctatccatagttggcattgctcattcctagggcttccgccgctctttccacgatgattctcagatctccatcagtcccagatygttccagggctctaggcacagatatgcagttgcctactggacatctctacttagttgtctcgtgggtttccccacttagacatggcaagaacaactcctc

SEQ ID NO: 68387 - DNA, 201 bp, Homo sapiens
tgcacaacagcaggaaaaggacataggaggcaggtgtgctgatcctcctgtgttaggtaggagacatagagtcttccttggcacttgagaagctccgaccaaaaaaaaaaaaaaaaaaaaggatactcccatgggtcagggttttgtctttaacaaagtgaaggaacaggaaggcctgagttagaggcaccctagacttgg

SEQ ID NO: 68388 - DNA, 201 bp, Homo sapiens
atgggtagatagatggatggaatgattaatcttggcccactaccttagctagatagggtcattgttctagcacatacccagaccaccaagcatgagtttgygtgtatgcacatgcatgcgtgcgcacatatgtgcataagtatatgtaagcactcatgtatgaattttcctgaatcttttccaaagacagaaaatttagaa

SEQ ID NO: 68389 - DNA, 201 bp, Homo sapiens
ccacagccagcagcaaactagcggcttgaggaactattcagcagacacttatgtagcacttaagtatgcaccagacacggttctgagtggttttacaagtkccaactcacttcatcttcataccaggtcttgacagagttagttactatccctgtttctctaatgaggaaactggaccacagagaggttagggactaaggg

SEQ ID NO: 68390 - DNA, 201 bp, Homo sapiens
cagatttctttgtcaccaattttccaatcatgcttcttccaagtccctgaccatccaaccaaaccattggctacagcccgtgaatcagtatataattgcayatctggccatttctccttgcttgcaaagtgcacaaccaggtgcactactcgaagtgcccactgggaagatttcccttcactgctgtccttagggatgtcc

SEQ ID NO: 68391 - DNA, 201 bp, Homo sapiens
gctgaggtcacccgctggtgaacactcacatgggatacaaatatcttcacagtttttgaccactcagagaggtccatctacatacctcttccccagatttstttgtcaccaattttccaatcatgcttcttccaagtccctgaccatccaaccaaaccattggctacagcccgtgaatcagtatataattgcacatctggc

SEQ ID NO: 68392 - DNA, 201 bp, Homo sapiens
cttgggttatttatttaaatctccccctgactctgcactgcctgctacctcgcaggcagtcattccaaggcatcgtcgttctggaaaagatacagtgtttktttttttttttaaattaaaaaaaagactttattgtgtagaacagttttagatgtacagaaaaattggaagattgtacagagtttccatctaccccattcc

SEQ ID NO: 68393 - DNA, 201 bp, Homo sapiens
tctatccatccatccatccatccatccatccattgatttaaaaaccatttaataagcatttaccatatccctgccttgtcctgggtgctgaactggatctsagagcctacttggggagataaatgtggaaatgtataactttaacacaatataaggtgtgaacatgctacaccaagcttttcatttttggtaggcctctgt

SEQ ID NO: 68394 - DNA, 201 bp, Homo sapiens
gtataaaacactgggaattaaagctaaacagaatgtggctccttccatcaaaccctgggtaatcacaaggaaggaaggcctataaggaaagaaggcagacragtgaggaaagaaggtagactagtaaggaaggaagactggtaagaaagtgactaataaggaaagaaggcagacgagtgaggaaagaaggtagactagtaa

SEQ ID NO: 68395 - DNA, 201 bp, Homo sapiens
cttctcctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagcctcggagctaaggctgggcagattcaggatggtat

SEQ ID NO: 68396 - DNA, 201 bp, Homo sapiens
ggctgagtgttcttttcatttctctccatatgtccatgagatcttgtttctgtggcttgacgcctttctaaacgcatatttcttgctttggtatctgggtkcccagagaacatcttcccctccaggagaggccatcagtgacttttgctgcaactttgtctgctcttgatcctgtgactgggaaggtcagcatatctcatc

SEQ ID NO: 68397 - DNA, 201 bp, Homo sapiens
cagagggagtttctgaggttgcagaggtgactgagcaatatcttccaagctccctggtgtattctggtttggccaagcaatgtgttgctgcaagagctcawggaaaagttaacacatgggaagggaaagaaatccattaggtgactgcattaatggatggggagagacttccaggacacagactttggcaaaatatggtca

SEQ ID NO: 68398 - DNA, 201 bp, Homo sapiens
ggcaaaatatctaatggatgctgggcttaatacctaggtgatgggttgataggtgcagcaaaataccatggcacacgtttacctatgtaacaaacctgcaygtcctccacatgtaccctggaacttgaaataaaaataaacattttttaaaaagagctatcaatacttccaaaagttgtgaccctggaaccatggcaattt

SEQ ID NO: 68399 - DNA, 201 bp, Homo sapiens
tgtcatgcaatttaagctgccctggtttactgaagtcattcgtggaaacaggctcccccaagtgacttccctcagaaaccctgtcctggccctgccaaccytctccatccacagttccctgtggtgtctctgaccacaggcatttggcttcagtcacctcccaatccgtagatgacctcggcctgctgcaatgtctgggtc

SEQ ID NO: 68400 - DNA, 201 bp, Homo sapiens
gtggaaacaggctcccccaagtgacttccctcagaaaccctgtcctggccctgccaaccctctccatccacagttccctgtggtgtctctgaccacaggcrtttggcttcagtcacctcccaatccgtagatgacctcggcctgctgcaatgtctgggtcccctgtcctgggaaatcaaggcagacaaagtgtccatgaag

SEQ ID NO: 68401 - DNA, 201 bp, Homo sapiens
ccactggcctcagtgaattctaatagtgtctaggccatgccctgcatgcctccttacatagagagggatctaagtgaggctggttaaatgctgccaagatkgttttcagaactgaggtcctgatagcacctgataggagacacactggttgaacaaacaattaaagagcttgcactatgtatctgacactatggttagaca

SEQ ID NO: 68402 - DNA, 201 bp, Homo sapiens
agatcccctagagctgctgaccagcgaatctttaccaaaccagttctacgggaggcgctgctgtgaagtggcttaaggcacagaatgtggtaaaagacaarcctccttttgacctagttggaagagattgaccacaaacatggaatatacccagtgcagtgggtcgcacaataagcggccagaaaatacgtattgaactta

SEQ ID NO: 68403 - DNA, 201 bp, Homo sapiens
tcagtgggagacctgagcttatttttctgcaactagacagtcccatctgggggtgacgggagacagtaacagatcatcaggcattggattctcataaggascacacaacctagatccctcgcatgcacagttcacgtagggttcacactcctgtgagaatctgatgccgccaccggcctgacaagaggcagagctcaggtg

SEQ ID NO: 68404 - DNA, 201 bp, Homo sapiens
gtaaataaactaggtggaggtcataggcagcgtactatgtcgatgatgaagttgctagtgtgtgcgcgtgcctgtatttttatacttgagctactatcgtrtgccatgctggggatcagcagaggttacttgtgccttgtgcattgctacttgcccctcttcccttttctggaaagttcttccttcttattctttcctcta

SEQ ID NO: 68405 - DNA, 201 bp, Homo sapiens
ctgggggtgacgggagacagtaacagatcatcaggcattggattctcataaggaccacacaacctagatccctcgcatgcacagttcacgtagggttcacrctcctgtgagaatctgatgccgccaccggcctgacaagaggcagagctcaggtgttaatgaggatggagagtggctataaatacagatgaagcttcactc

SEQ ID NO: 68406 - DNA, 201 bp, Homo sapiens
agtgatttattaacaaagtagaaacatttaaaatacagaaagaaatgcagaaataatggtgatggtgtttcagaaatggtgattgagaaagcatactttargtagtgaattgccttttaaaggaattaatagcaaaaatatctcttacttgtcattgttttcaccatttccggtactctctatttcattgtgtagatccaa

SEQ ID NO: 68407 - DNA, 201 bp, Homo sapiens
aacaccgcatgttctcacttataagtgggagctgaacaaatgagaacacatggacacagggaggggagcaacacacactggggcctgttgggagatggaarggggtagggagagcattaggcaaaatatctaatggatgctgggcttaatacctaggtgatgggttgataggtgcagcaaaataccatggcacacgtttac

SEQ ID NO: 68408 - DNA, 201 bp, Homo sapiens
tagaacataaagaaaaggacccaaattaagctgcaggcctggagttcagactaagaaattctatgtgacccaaagggacaggaagcactaggcagaggagstgagtgtggctgcaggatggccgttgtagacgtctttgtgatgagcacaggaggctcatggcctgctcgctagaggcaggagggtagatcagatcatagc

SEQ ID NO: 68409 - DNA, 201 bp, Homo sapiens
cttagtagcctaaagcaacagtcatttcattttatctcatgattttttgttcaggaacttgggcagagctgggctgggtgattattctgcttcatgtggtrttgactggggtcacttggtggtagccagcttggaggtgggatggacgggagggttcaggaaggctttagttgtatgcctgctgcttggcagggcagctgg

SEQ ID NO: 68410 - DNA, 201 bp, Homo sapiens
acccccatatttcttgaatttttcataatgagtgtagaaagaggtcccagcactggaaaggaaggtggggagctgttcccctcattgcttacagtggtctrcctcttgtagacacaaacctctaccttgaggagcccctttctgagggcaagtgtgcttctgagagggcagatgccagccatgcatcacaatctagggagg

SEQ ID NO: 68411 - DNA, 201 bp, Homo sapiens
atggaggcttgaagagtcagttgacctgcagaccgagatagagcttaaggtggaaacttggatgaaacctttaggctgtcccttccagtcctcagcgagamcctagggatcaccatgtgcaatgctatgtggatgtggcgtgtgacaccacaggcaccagagggagtttctgaggttgcagaggtgactgagcaatatctt

SEQ ID NO: 68412 - DNA, 201 bp, Homo sapiens
cctccctgtgcatgcgtgtgtgtgtgtgtgtgtgtgtgtgtgtgtgtgtgtgtgtgtgtagtccagcacagcttattttttcagggagccttccacctgcygttttctctccctacgttttctatttagtccttcatagccagtgcccattctctgtcctgcggaggaaataggacctgaacagcttcctttacagaaaga

SEQ ID NO: 68413 - DNA, 201 bp, Homo sapiens
aacaggggaaaagagccttgagttttttcctggggtctattctgccctggactttggttggaggacctcacccacatctgtggatgtctcctctgtgcctscttctttgtgggtgtctgagcacctcagctgtttgttgcaaagcagacttcattgctgggcatctctttatagactggcataggctggggactcaggagg

SEQ ID NO: 68414 - DNA, 201 bp, Homo sapiens
gtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtga

SEQ ID NO: 68415 - DNA, 201 bp, Homo sapiens
ggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtg

SEQ ID NO: 68416 - DNA, 201 bp, Homo sapiens
tggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgt

SEQ ID NO: 68417 - DNA, 201 bp, Homo sapiens
gtggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactg

SEQ ID NO: 68418 - DNA, 201 bp, Homo sapiens
tgtttatgtggaatcagcttcacgtggctccttagctctgaccctgcttctgcttcctttcccttttccccatccttatacctggggagcaggaaatgcaracagcttcagtgtcaagccatgttttaagtggagaaggatgaagaacactgtcatgttctcgcaggccttccacacttgtagacgcaccaactgtcccac

SEQ ID NO: 68419 - DNA, 201 bp, Homo sapiens
gttggtatggaatgacgttctcatcagtgttaggcaaaaaatccccaggatgatgcacatctgggttgacagccacacagtttagatgatgtttgaggtaktttttttttttttaatccaggatagtctatacataatttaaaaatctacccagaggccaggcacggtggctcacacctgtaatcccagcactttgttggg

SEQ ID NO: 68420 - DNA, 201 bp, Homo sapiens
agagtagcattgtagtccacaccttgtggacttcagcaaattgcatcacttttccatgcccgtttcttcatctccaaaatggtcacgtgactgggttggtrctctgcaagttcctgcagctcgaaagctctgtgaatcttgagatgctctgggaaacaccaaacgagaggttcagagcttgatttctatagtgggatagga

SEQ ID NO: 68421 - DNA, 201 bp, Homo sapiens
aaaaaagaaagaaagaaagaaagaggttttcccttataaaaccatcagatcttgtgagcttattcactaccacgagaacagtatgggggaaaccgcccccrtgattcagttacctcccaccaggtccctcccgcaacatgtgggaattatgggagctacaattcaagatgagatttgggcagggacagagtcagaccctat

SEQ ID NO: 68422 - DNA, 201 bp, Homo sapiens
gagaaggatgaagaacactgtcatgttctcgcaggccttccacacttgtagacgcaccaactgtcccacttttagtgttcctgatggtcaatttctctttytttcttcaaaccaaatgttaagcctgagcaggacatgattagcaatctgcttgaggataaaatgttataaggtatgcgtttgttccctgctccatctcct

SEQ ID NO: 68423 - DNA, 201 bp, Homo sapiens
gttatgacccaggcattgtgccagggctggtaacacagtgggggacagaactggtgcccgcccaagggggcagcgtggtattatggaaaagcacttaagtsctatagacctgagcatgaatctcgattccaccactccttaatgtgtgatcctcaccagatgagtcaacctctctgagcctcagtttcttcatctataaaa

SEQ ID NO: 68424 - DNA, 201 bp, Homo sapiens
ggctgtgccaggatggcagggaccacacgttaaatgcggaggtagagcaaatgctcccccatgtttttttttttaaagggagagttcactttagttttttkttgttgttgttgttgttttccattttattttatggtaagccctcgatgactcagaaagagttggaagggacctttgagagtctttaattagcgtctcatt

SEQ ID NO: 68425 - DNA, 201 bp, Homo sapiens
ctttgcaattgtgaattgagctgctataaacatacatgtgcatgtgtcttttttatataatgacttcattttctttaggtagatgcccagtagtgggattrctggatctaatggtgttctacttttagttctttaaagactctccatactgtttttctatagtggttgtactagtttacattctcagcagcagtgttaaag

SEQ ID NO: 68426 - DNA, 201 bp, Homo sapiens
tacatggataagttctttagtggttatttctgagattttagtggacctgtcactgagcagtgtacactgtacccaatatgtagtcttttatacctcacccsccttccagtccccaaagtccattatatgattcctatgtctttgtgtcctcatagcttagctcccacttataagtgagaggatagaatatttggttttcca

SEQ ID NO: 68427 - DNA, 201 bp, Homo sapiens
tttacaaagagtggttgggaagattgcatgggatagggtgtgcacaaagtcagtactgtggatagcagtgataaaagagtggtaccatgcatcagaagtargtcctagaatgtgacaggtgaggtatggggacatatgttcgccaacagtgctcattattgatgcgtggtctgaggaaggactgattggtttggagataga

SEQ ID NO: 68428 - DNA, 201 bp, Homo sapiens
ttgcatcaatttatattccccattagtagtgtaggagagttccagtttccctacatcctaccaacacttaatattgtcagtcatcttaattttagccattytgatacatgtgtagtggtatgtcagggtggttttaatttgcaatatctggtgactgctaatgagataaaaaccttttcatatattttttttccagccatt

SEQ ID NO: 68429 - DNA, 201 bp, Homo sapiens
actaagctcagagaaagggtttgtcttggggcagggtgctggtggtgaggccttcctccggcaacatcacatgggtcctcgtggcctgcacctcctcccartcctgcacaacccaacttgtggaaccttactcatgtctaggttggaaggaaattagctttcttagtagtatctgaatattccagtcttacaccttgatta

SEQ ID NO: 68430 - DNA, 201 bp, Homo sapiens
acagggagccatacttagcctggcgttttggcacgatgcttctaaaaccaaacagaggggcatctttttgttgttcatcccctgcctgttcaagtgactgyccagcatgtttgccttttatctaagccatggctgagtgttcttttcatttctctccatatgtccatgagatcttgtttctgtggcttgacgcctttctaa

SEQ ID NO: 68431 - DNA, 201 bp, Homo sapiens
ggccacagcacagggtttagatgtattcaaagttcatagtcatttggcttaagatgttcgtatgatggtatagaaaaggctgtatatcaaggattcatatstcaggatgctccttgacttacagtggggttatggtggataaacctgtcataagtcagaaatattaaaagtagaaaatgcatttaatggcctgataaacct

SEQ ID NO: 68432 - DNA, 201 bp, Homo sapiens
ctgtccaggatgccttcagcctagcaggacagggcaggctcctggacacggagagcactgggcccagagaagaggcaggcatgtgtggggcatggtctctsctcgcctgcaggccacgcaggaaggaggaatccttcttaacgggtcatttcacttactcatttcagaactggttactgagcagtatgtgttatagtggct

SEQ ID NO: 68433 - DNA, 201 bp, Homo sapiens
ctgaagtcacaagccaggagatcacagcataactcctctcagtgtatggcttgcatttattttgtgaaagcagtcagagtcccctctctgcccttgaacakgccattctgtgagaggctaaatttatagcattggctgccagattattaatctccacctgaaattgcactggggaatcccccacactcagggcaactgatg

SEQ ID NO: 68434 - DNA, 201 bp, Homo sapiens
tgaaaatggtttcttctgccatcctagttaaaaaacaaacactattttagatgtatgttgtctgcatcctggcataagagcgatgactgtccataggtggrggctagaactgattgatgttgctaacaaaacaatgaacaatgtttctttacttttctgaccagagcacatggctgttggcaagactcattattgtgcatg

SEQ ID NO: 68435 - DNA, 201 bp, Homo sapiens
gtaggaaaactaatggtaggaactaggagtattgagcctgaagaaaataagaataagaggagatttcatcaagaactttaaacaaatgctctaaggttccrttctccagtctgtgggctagaacataaagaaaaggacccaaattaagctgcaggcctggagttcagactaagaaattctatgtgacccaaagggacagga

SEQ ID NO: 68436 - DNA, 201 bp, Homo sapiens
tggtaatgtcaccgggctttctctgggtttacccatgctggactgctcttctccaaaccacacctctctgtgtagcctagatggagctccctgatttagaytctcgtccaagcagagtactttactctttcctccatgggctggagcctttccaaatgctttaagtatttgtccttagtcctagaatattctgcccattcc

SEQ ID NO: 68437 - DNA, 201 bp, Homo sapiens
caagttatccacccacctctgcctcccaaagtgctgggattacagctgtgaggtgccatgcccagcctagtctttggttttactaaaaaaaaaaaaaaaaatttcatggttgaacaaattcagaaaacactaatgattacaatttaccaggacagtcaaagttttgagaagccttgtagtaaaaacaaacaaacaaacaaa

SEQ ID NO: 68438 - DNA, 201 bp, Homo sapiens
caggataccatggagtaacaccagaggaggggacaggaggatcttgtcacttcaggtccagcattgctgagcccagtctcttgaggccatccagtgctgarcatagagacttacatggcgaggggaaggaggagggacattttgttatgggactggggtgattaacaggagctattagagagcatcaagccagcactggaa

SEQ ID NO: 68439 - DNA, 201 bp, Homo sapiens
ttttgaaaatcttgtagataattttaaaagtgcaaggcaataaaggaaccaggattactcactcacaattttaatctaacgggaactggttttccccagcraggacctgctgtgtgtgcagtctcgtgctaggtgcttgaagaatacagaagaagtttcagatactgtcccgcagtcaagaagcagtcattttacctgggt

SEQ ID NO: 68440 - DNA, 201 bp, Homo sapiens
ggccaggtgcagatatgtctatcagtaaagcctgtcctagagcaggagttagcaaactgtggcctgcaagccaaatccagcttcccacctacttttgtaartaaaattttaccagaattcacctacacttattcacttatatattgtttatgacttcttttgtgactcaacatcagagttgagtagctgtgacagaaacca

SEQ ID NO: 68441 - DNA, 201 bp, Homo sapiens
agagagactgaacaagagcagcaaaggaaataactaaataactccttcccaagggcctctaatgagatgcaaggccaagtgcaggatcttccaaagggtcmcatgaactgccacctctacttctggaaggtgccccagacaggaccactgtggaagccccactctctgtccaggcatcttccatcaggcagcagccgcccc

SEQ ID NO: 68442 - DNA, 201 bp, Homo sapiens
ccccaagtggtctatgcaatgccctctggccccagtttgatcaagatctctgccttttttcctggggctttagtctgctgctgtgtcctttgcatcaggamaacaaaggcagctctgtttggggatgtgggcgacttggctgtgtcctgttctccattccttttgctccctcctaattgctctttcagaccaccccagctg

SEQ ID NO: 68443 - DNA, 201 bp, Homo sapiens
agtgagggaccctgggttagactatgagctccttggggccatcccaaggacttctttacctggaaaggatgtgggttgaatgacaggtaagccaggatgargatgagtttttggtacttgctctctggatgcccaggacatagactggtcaaagtgagaccagagcaggtgcgcgatcctatggagagctctggggaaaag

SEQ ID NO: 68444 - DNA, 201 bp, Homo sapiens
tctcttgatgaatatggtggcattaaaatcatatgtaaggtgtcttcaagctctaacaccctatgaatttctctcgaatgagcaaagctggtcactgctgmttccaaatacaagccacccctctttcaaaagatgtttcctttcaatttctactctgccagaggatgtgtacaacataattatgtagttaaattcaaggat

SEQ ID NO: 68445 - DNA, 201 bp, Homo sapiens
tcatatctccccattcagttcttaacctcatcctcataatttcccctctgtttcttcctctgccctcctgtccagcatatctcccctttgtggctctgagkacccccaagtggtctatgcaatgccctctggccccagtttgatcaagatctctgccttttttcctggggctttagtctgctgctgtgtcctttgcatcag

SEQ ID NO: 68446 - DNA, 201 bp, Homo sapiens
cctctcaaagcttgaagaaagtcatgcagaacgtccagagaccctggcagctgggcagacaccacacacacacacacacacacacacacacacacacacaccaccctaatgtcaaacacgcacacatgcacagaccaccctaggatttgtgctatttccaatcagtggcataaatgactgagcaagagaagtttactcagg

SEQ ID NO: 68447 - DNA, 201 bp, Homo sapiens
acctctcaaagcttgaagaaagtcatgcagaacgtccagagaccctggcagctgggcagacaccacacacacacacacacacacacacacacacacacacaccaccctaatgtcaaacacgcacacatgcacagaccaccctaggatttgtgctatttccaatcagtggcataaatgactgagcaagagaagtttactcag

SEQ ID NO: 68448 - DNA, 201 bp, Homo sapiens
tttcattcttccaaacacatttttcctgtcattcattcactcattcatttattcaatgcatgttcatagtagagcacatctggcaatagctggggtctgcytggaagatgtctctctgggactttgcttatggagagaagccctccaaactgtatgcgggggtggggcaagagtgggagtgtggcgagcgcgagggttcag

SEQ ID NO: 68449 - DNA, 201 bp, Homo sapiens
ttcctgcaataacccttgctatagatgaatttttaatattaaaatctgtacgtgtctacctatatttctattaaatcttttacaacatttttaccaaatayggtatttcctaaacaatgcattatgcggttgaagatgctcggcaaagtaatcctattcactacagttctcaatcccattgagttttctctggcagcttag

SEQ ID NO: 68450 - DNA, 201 bp, Homo sapiens
ggaagggaaagaaatccattaggtgactgcattaatggatggggagagacttccaggacacagactttggcaaaatatggtcatcataaagaaaatggctragtatatctctaggctttcgagtattgtcatttgcactgtgttatttttccctccaaggggttatttggggaaaattgtatacatcccaggattgaactt

SEQ ID NO: 68451 - DNA, 201 bp, Homo sapiens
ggagtgcggttgtgaggggtttgctgctgcaggtacagtctgtgtgtgagtgtgtgtgtgcatggatgctggagcatgtgtgaaggcaccgatgcccagaytgtcaacaggtgggtggagggcctcgcaagctggcatgacagattaacttaggccattcggtccttttactgggggcactgggggcctttgggcctgaga

SEQ ID NO: 68452 - DNA, 201 bp, Homo sapiens
gcaatcttggctcactgcaacctccgcctcccgggttcaagtgattctcctgcctcagcctcctgagtagctgggattacaggtgcacaacaccatgcccrgctaatttttgtatttttagtagagacagggtttcaccatgttgctgaggctggtctccaactcctgactgtgtgatccgcctgtctcggcgtcccaaag

SEQ ID NO: 68453 - DNA, 201 bp, Homo sapiens
aaagagaacctgtttatggggttgtaataaccatgtattcatggacacaactgcttatgtctgtgaaggatcagcaattcatcagacacttagtgagttaytttcttctctgattgtcagagtgaaaggtgagtaagatcacttctctcagggagctcacagtcatatgcactgagtcacatgacatagagtggagagtga

SEQ ID NO: 68454 - DNA, 201 bp, Homo sapiens
cccctaatatatcatttctttgtgttgtaaatattcacaatcctctcttctaactttttggaaacatacaataaattatattaatcctattcaccctgcartgctgcagaacactggaaggtattcctcctatctagcttaactttggatccattaaccaacctctccccatcctcccctctccacattttgcccagcctc

SEQ ID NO: 68455 - DNA, 201 bp, Homo sapiens
ggcaggcttactcttcgtcttcttacacaactcacttgattatcttcttaattcacagctctggttttgtcactgttcacactgttcagtgtcttccactkccttgtgtagcagatctccatgcactcatctcagtttgccccaactgagtttcatggagatctgctgcacaaggcaacagaagattgttgcacatgaaga

SEQ ID NO: 68456 - DNA, 201 bp, Homo sapiens
tgattttattattgatcattgagtttgatctgatgcatttcacagagacttggctctgtggctgtgcccttggctccaggggcagcagctatactgatgaygagtttttccattcccccagccagaaggcaagaggtggtagggtagatgcacatgtactcctccctttcttctggaaagtctgatttggatgcatgcata

SEQ ID NO: 68457 - DNA, 201 bp, Homo sapiens
aggatcggatggttttaaacattttgggccccaggatgatgttcatacgcatctccttctgagattacttcatacatggcgagcagcgtggctgaatctgrtcttgtggtatttattatctgaatccatggatgggaatttccctcctcccctccctgcaccttgcctttcccatatatgttcatgcaaaatagactttgg

SEQ ID NO: 68458 - DNA, 201 bp, Homo sapiens
ggatcggatggttttaaacattttgggccccaggatgatgttcatacgcatctccttctgagattacttcatacatggcgagcagcgtggctgaatctgakcttgtggtatttattatctgaatccatggatgggaatttccctcctcccctccctgcaccttgcctttcccatatatgttcatgcaaaatagactttgga

SEQ ID NO: 68459 - DNA, 201 bp, Homo sapiens
tgctcgctagaggcaggagggtagatcagatcatagctgggtgtcacttaacactccttgctgcaatgcatatgagaaaagctgctcttcaggtctgtggrccacgcaattgactatttttctcaaactgttgagaggttgctatgaaccttttgcatttttccttcggttttcctcagatccatgagagattggcactgg

SEQ ID NO: 68460 - DNA, 201 bp, Homo sapiens
catgctcctctccactctgctcctcagagtggagaacagcatagagaagtttcccaactcatcagaggcacttacccagaggtctcagcggaatcagaacrtctgttgctcccctttctgcaagtttgtttcttcctaagatgggagaagaatagggatagagaggggatttgggtgctgtgaactttctttttccttgaa

SEQ ID NO: 68461 - DNA, 201 bp, Homo sapiens
attccatgcattacctcatttcatctccatagcagcaatctcataccgttggcactattttcaatctctttgttatgggtgaggaagtggaggtatagagmagttggtaacatgcctgaagtcacacgttcaattagcgtgcaagctgggaattgaacccaggcagccacctccaggctagaccatactgcagtattccca

SEQ ID NO: 68462 - DNA, 201 bp, Homo sapiens
catactgcagtattcccaggacatggtgagatgccctccagcaaggaagaagaaaagggggatgaggagagggagagaaagacaaatgagcaaataatatwttttctcaaatgtaactttatggtcccatttcacagattgctggccttgaacctcactatctctttctcctttgtttcagtccacatatatgtggagggc

SEQ ID NO: 68463 - DNA, 201 bp, Homo sapiens
agatgccctccagcaaggaagaagaaaagggggatgaggagagggagagaaagacaaatgagcaaataatattttttctcaaatgtaactttatggtcccrtttcacagattgctggccttgaacctcactatctctttctcctttgtttcagtccacatatatgtggagggctaaggtggcctgaagtcacaagccagga

SEQ ID NO: 68464 - DNA, 201 bp, Homo sapiens
agaagaaaagggggatgaggagagggagagaaagacaaatgagcaaataatattttttctcaaatgtaactttatggtcccatttcacagattgctggccytgaacctcactatctctttctcctttgtttcagtccacatatatgtggagggctaaggtggcctgaagtcacaagccaggagatcacagcataactcctc

SEQ ID NO: 68465 - DNA, 201 bp, Homo sapiens
gtaactcataaagccatgggcaagctgcttctcagagtctaactgtcctcatctcttgatgaatatggtggcattaaaatcatatgtaaggtgtcttcaarctctaacaccctatgaatttctctcgaatgagcaaagctggtcactgctgattccaaatacaagccacccctctttcaaaagatgtttcctttcaatttc

SEQ ID NO: 68466 - DNA, 201 bp, Homo sapiens
aaatgagcaaataatattttttctcaaatgtaactttatggtcccatttcacagattgctggccttgaacctcactatctctttctcctttgtttcagtcyacatatatgtggagggctaaggtggcctgaagtcacaagccaggagatcacagcataactcctctcagtgtatggcttgcatttattttgtgaaagcagt

SEQ ID NO: 68467 - DNA, 201 bp, Homo sapiens
cactggttcctgtgtctctagtcttctgaaggcacctctgaggtttctgctcagtgtctctgagtccttctgggaatgccagctgactcctctgcttggayctgatagaacacccagggcccgtgacctatgagtcaaaccttaggctcaagctgtttgtttcactcatcttgtctatgacaagcctttatcatttgagtg

SEQ ID NO: 68468 - DNA, 201 bp, Homo sapiens
ggttttactcccactattcccttgaaatttcctcacaaaggttgcagatgatcttaatggcaaattctaatggacgccttgctgctcttaacttacttgawctctctgtcaagaagagctgtgcctctatgtcccttcctgagttttggtcacactattctcttcttactccttccaatattttggctacttcatggtcca

SEQ ID NO: 68469 - DNA, 201 bp, Homo sapiens
cttagtccactttcaggctgtgcttcttggtccatatgatgtagtattagtgcttttcttctacctctgaagactgtggccctgtgctataagcctaatayttgtgttccccaaaattcctatgttgaaattctaactgccaaggtgatggtattaggaggtgtggtgtatgggaggtgatgaggccatgagggcagagca

SEQ ID NO: 68470 - DNA, 201 bp, Homo sapiens
gatgacagagcattgcacgacatgagaggctgtggagtacaaggaaggcactggactcacacacattggattccagagctgccacttattcacttgtgaaygagttccataaccttctggaaccttcaggtcctacggctatagaatgggaataataatcacacctcacgagttattgcagtaattaaatgggatatgtct

SEQ ID NO: 68471 - DNA, 201 bp, Homo sapiens
acctctccaagtcacagggttgggttcattgtagttgcttgaaaaaagagtattagtcaagtcaaggtttttaggaaaatggctgtgcttgggaggtgctyagacattactgacagcccactcctgagtgtcactgccccagatgctcctgaagcggggccagggatgagagtgaaaggagtgatggggaaaggccgtgag

SEQ ID NO: 68472 - DNA, 201 bp, Homo sapiens
aagcgcagtattagggtgagagtgacccgattttccaggtgctgtctgtctcagcttcccttggctaggaaagggaattccctgaccccttgcgtttcccrggtgaggggatgcctcgccctgctttggctcatgcttggtgcgctgcacccactgtcctgcacccactgtctgacaagccccagtgagatgaacccggta

SEQ ID NO: 68473 - DNA, 201 bp, Homo sapiens
ctacggctatagaatgggaataataatcacacctcacgagttattgcagtaattaaatgggatatgtctaaggcacatagccaattgtcagtcacattgcmaacaatttaaaaatggtggctcttattttttggtgcgtctgcaggctgggtggccacacccagcagaaggaaatggtttaagagagttaatacagttccc

SEQ ID NO: 68474 - DNA, 201 bp, Homo sapiens
ttcaaagggcttctcctttgtaaatcctcttctggcctctcggctgtcagtggtcatcctcccacttccagactcccctggcacacaccctctgtttctgrgttcatccatcagctgttgatggagtgcttgctccgtgccaggcacagttctggaaacacagcaaagacaagcgacaaggtccctgctctcattttgctt

SEQ ID NO: 68475 - DNA, 201 bp, Homo sapiens
ctctctttattagtgatgttgagctagagtttttctttcttacattttgtgtctggtttaagggccaagattgtacaagccacacagtatgagtttggagygctccttctttttctgttctctggaatacattatagaaaggcagggttatgtgttgcttgagagtttgataaaactcatttaaaaaaaatgtgtgccaac

SEQ ID NO: 68476 - DNA, 201 bp, Homo sapiens
ctgctggccaaagtgaagtagggttgacattaggacattgaagagcaagtcagtttctggatctcagttgcttgtgatgatggcaggattggggaagatartgatgcagatgataatcacaaagtacaagtccttatggctgaatggtgtgccccccaaaggagaggctctcatagacagaagagtaaaggcttggaagtg

SEQ ID NO: 68477 - DNA, 201 bp, Homo sapiens
cttgatggatgcacttgaggcttaagtgacaaggtgggctcatagtgtttccattgtctgtgtgaggaaggaactaagggcattgatggaactggtgttgygagtcctcaggacagcacggctcccaccactgctgtgatccagcctgtgaacgtcagcgcagctggtgtccttgggtgggcgcttgctgcctgctttggt

SEQ ID NO: 68478 - DNA, 201 bp, Homo sapiens
gtgccaacttctgggttttgtgagcagatttttaatttcaggcttttttttagtggttttgttatattcatgttttcattttcttcttgattccatattgktatattttcctatttatgtattttcaagttattggtatgaaatttttcatagaattgtcttttgaagaattgctacatctttgctgcatctgcaattatg

SEQ ID NO: 68479 - DNA, 201 bp, Homo sapiens
cagaaaaatctgttgaaagttgtccacagccagcagcaaactagcggcttgaggaactattcagcagacacttatgtagcacttaagtatgcaccagacayggttctgagtggttttacaagtgccaactcacttcatcttcataccaggtcttgacagagttagttactatccctgtttctctaatgaggaaactggacc

SEQ ID NO: 68480 - DNA, 201 bp, Homo sapiens
attccctggccgtcactccccaaccatgcagtgagtcagggcctggagtgcaaagagatgatgtgttgactccctgggtgggggtgggggtggggggtggygggaccagagtgggaccagggactggaatgtggggcaggctgcagagtggagaggctcgctcagatgaaggcactactgtgtcaccattggctcctgggt

SEQ ID NO: 68481 - DNA, 201 bp, Homo sapiens
gccaggactctattcggattccttttggcctactccggacacctcctgggcatcattggcagtagggtgtgcagttagcactggtttcctatgcccatggrgaagagcagtggtgcagatctccaggaagacagatgagataaagtttgtgttggctttgagtggagtcagccttaatggactaaggacccctttcttgag

SEQ ID NO: 68482 - DNA, 201 bp, Homo sapiens
ccgtcactccccaaccatgcagtgagtcagggcctggagtgcaaagagatgatgtgttgactccctgggtgggggtgggggtggggggtggtgggaccagrgtgggaccagggactggaatgtggggcaggctgcagagtggagaggctcgctcagatgaaggcactactgtgtcaccattggctcctgggtcctggctcc

SEQ ID NO: 68483 - DNA, 201 bp, Homo sapiens
catgcagtgagtcagggcctggagtgcaaagagatgatgtgttgactccctgggtgggggtgggggtggggggtggtgggaccagagtgggaccagggacyggaatgtggggcaggctgcagagtggagaggctcgctcagatgaaggcactactgtgtcaccattggctcctgggtcctggctccaggtggggagaagca

SEQ ID NO: 68484 - DNA, 201 bp, Homo sapiens
atactagctcaggaatcttaattagccatggacagtcctcaatatccccatcatggctcattaaggattgcaaggtgttgaggggcatttcaaagaactcrgggctagctagtaacgttgcacagtggttaagggcttgaactctggatttggactgcctggattcaaatcttgactctgccactctgggaaaacctttct

SEQ ID NO: 68485 - DNA, 201 bp, Homo sapiens
caaagtgaagtagggttgacattaggacattgaagagcaagtcagtttctggatctcagttgcttgtgatgatggcaggattggggaagatagtgatgcaratgataatcacaaagtacaagtccttatggctgaatggtgtgccccccaaaggagaggctctcatagacagaagagtaaaggcttggaagtgataggcag

SEQ ID NO: 68486 - DNA, 201 bp, Homo sapiens
agtagggttgacattaggacattgaagagcaagtcagtttctggatctcagttgcttgtgatgatggcaggattggggaagatagtgatgcagatgataawcacaaagtacaagtccttatggctgaatggtgtgccccccaaaggagaggctctcatagacagaagagtaaaggcttggaagtgataggcagacagcacc

SEQ ID NO: 68487 - DNA, 201 bp, Homo sapiens
tagatgtttcaggatttttcgcatctgggcctataaagagtctgactctcatactaaaatcacattgcaggcagatttgctgccaggctatgcactgcctgggggcccctctgcatggctgacatgctagactgtctgtccatggtgctggacttgggtctgcagaccccagcgacatagttccacagcacagagggtctg

SEQ ID NO: 68488 - DNA, 201 bp, Homo sapiens
tgctactacctagggccaagaatttgagctgttctcctatgtatgcctagtgcctggtgctagcatgatgcttggtacatatttgatgttcaatgtatgcytcctgtatagaaacaagagtaatacaactcacaattatacagaacttataattttccaagtactgtcacatatgtggtatactcattgagtgctcagtaa

SEQ ID NO: 68489 - DNA, 201 bp, Homo sapiens
ctctctctctctgtctctggtaaacccttctgctaaggaactgaagcagagatcctcgaagctttggggactggcgcaggttggtggtgcacatttttttrtagtggagagttttggaatcaaacagagctggtaaattggccaccttctagttttgctatgttgatggaggcctcactctgttgcaggcacaaactctgg

SEQ ID NO: 68490 - DNA, 201 bp, Homo sapiens
ttttccaagtactgtcacatatgtggtatactcattgagtgctcagtaaggaaagttaccagttgtcccattagaccccattagagatgctgatttgaggrcacagataatttgaacaatatgccctaggttgctcagcttataaagaggtggagacggaatgaagcccacatcctgtatttccaaatccattgtatttct

SEQ ID NO: 68491 - DNA, 201 bp, Homo sapiens
tgagcaaacccagatgcaagtggaggagctggtcatgtggcagtgaggggaaaggaatccgggcagaggaagcagcaaatgcaaaggtcctgatgtagagyaaactcgtgcaaggaacagcaaagaggtcagtgtggccggaccagccttgagagaggcagtggctggagaagaaggaaggagagggtctgggccagggta

SEQ ID NO: 68492 - DNA, 201 bp, Homo sapiens
gataatgaagtggccagtgacgatggcaaggtttggcttcctgtcctttgtgggcttcccaaagaatgaggaccacagcctgcttcttttgaagcccaaayccagttccactccagtcctggccacttggcatttatcgtcttcattctctttttagggttgggagtaacctgcactggtttcacattggtatgactgagt

SEQ ID NO: 68493 - DNA, 201 bp, Homo sapiens
ctatcgtctccaatggggagacaggcaaggagcctcatgctgggggcccaggtgacattgagctgggaccgctcgatgccctggaggaggagaggaaggarcagcgggaggaatttgagcacaatctgatggaggctggactggagcttgagaaggacttggaggtgagtcaggcgggtggccagggacttggagatggaa

SEQ ID NO: 68494 - DNA, 201 bp, Homo sapiens
acagtcctgctttaagcaaattcaaaatataaaaatctggattaaaaacctaggagaatctgtagatactgccccttcagagaggtggagtgtaattcccmcaccttaaatgtgggcactttgtgactttcttctgaagagtaaagtatggaaaggagaaaaaaagaaactttgcaatagaaaaatctgacagatatgatc

SEQ ID NO: 68495 - DNA, 201 bp, Homo sapiens
gcatgaaagaaagaggtcaaggatgacgccaagattttgatatgaacttgaagaatatcggtgagggaagacatcaggtatttacttatgaacatgtgacrtttgtgacagctgctgcatatccatgtagaaacgtgcaacattcaagggaatctcttagctggagagtcactgacatttagatgatttttcagccatgag

SEQ ID NO: 68496 - DNA, 201 bp, Homo sapiens
cttctcctcagcgtgtcctcagtatctagcacagagcctggcccattggcactgttcagactgtgtctgttgagtgggactgaaccaagactccagggggrctcaggaaaagtccctccctggcccctcaaatttctcttcagaatccctattgagtgttatcattcgtcagcccatcctcagttttccttgtcaacagct

SEQ ID NO: 68497 - DNA, 201 bp, Homo sapiens
acctggcccaaggcttccctggccactcgctggctatcgtctccaatggggagacaggcaaggagcctcatgctgggggcccaggtgacattgagctgggrccgctcgatgccctggaggaggagaggaaggagcagcgggaggaatttgagcacaatctgatggaggctggactggagcttgagaaggacttggaggtga

SEQ ID NO: 68498 - DNA, 201 bp, Homo sapiens
caatacttttcaatcttctttgttctcagtctctcttttcctttgcctggcggaagcgttccctcacactgtctgcctcatgaacttcaggccctactacrgggcgcaggggacagcttcgtgccatcacacctccagaccacctaggctactgacatctcactacaaaatcaggctgtttcttgatgcaggggtttcaca

SEQ ID NO: 68499 - DNA, 201 bp, Homo sapiens
gccaggtcatcaacaactatctggatgccaatgagcctgtgtccttggaggcccgtcttagccgcatgcacttccatgacagtcagaggaaggtcgactaygtacttgcctaccactaccggaaacgcggggtgcacctggcccaaggcttccctggccactcgctggctatcgtctccaatggggagacaggcaaggagc

SEQ ID NO: 68500 - DNA, 201 bp, Homo sapiens
tcaggccctactacggggcgcaggggacagcttcgtgccatcacacctccagaccacctaggctactgacatctcactacaaaatcaggctgtttcttgaygcaggggtttcacaggaaaactgcatggcaggtacatggcagcccacacttgggcactgtgaattgccgccaggacctgaacttagattcttgccatttt

SEQ ID NO: 68501 - DNA, 201 bp, Homo sapiens
gccaaaagggcacttatgtggttttattactgtgctacttgctgtctggaggctcagaatgggagccatcatcaagggacatagacacaaagagctgagamaaagaagctagcacagaggacagctaggctcctgtcttaacaacgattgcattagctaagtgctttatagtcacctgcttttgatataatcatgaagctg

SEQ ID NO: 68502 - DNA, 201 bp, Homo sapiens
atcttacataaagaaaatgaggaggacgaaaacgtaggagtcatcctagattctctgtgttccctcaaaccccatagttaatccactggtaagtgcctttractctactactaaaatctatccttgctctgaacatctttcactctgttcatactgcaaacctagtccagatccccagcagttcttgccaggggtattgca

SEQ ID NO: 68503 - DNA, 201 bp, Homo sapiens
tctctttgtactgtcttatatgctggctataggatttttaagcagagtatatttaaattaaggatattttgctgcaagtcttcgtattgttaatgtatccrtgaatggagagttttaattggcttccattattagagccagattattataagtaaagactactttactcactgtcatctttactagtgactttggcagctt

SEQ ID NO: 68504 - DNA, 201 bp, Homo sapiens
ttaactcagttggttaaaatgattttctatatttcctagatggcatccctctttctctttcatccagggggtgtctgtcaccctttccctccatccagatwagggcatgtgcatgcacacccatatgtcctctgctagggctgagatctttcacctttgctgtcaagtctgttttgcaaaacctacccaggtttccagaag

SEQ ID NO: 68505 - DNA, 201 bp, Homo sapiens
ctggaaggctcttactcaatgatggctttggctacctgctcctcactctgccctctcctcatcaccatctcagccctggctgcagtgatctgtcttcctgycttcatctgtggaatttgctttattccacctaccaggacctgcaatggtctttttcatttgcttatttctttttttctttttcttcttcttcttcttttt

SEQ ID NO: 68506 - DNA, 201 bp, Homo sapiens
ggtctgactagtttaaaatggcttcagggctctagaaactcaatcttctggctggaatgttgggcggcagcactgtgtgacagcactgggctgagagtctrgagacgtgagttctggtctgggcctggccactaagtgctaccatttctttgggcaagccccaattcctctttgatcttcagggtcctggttgtcctaact

SEQ ID NO: 68507 - DNA, 201 bp, Homo sapiens
gttaccttgttctcattgtgtgatggaaagcctgttgggctaagagtctagcaaccggattctatcactaagtctgtgcaaacctgaatctattgcttgtktacataatctgtaaatgcaagtgctaattaccaagtgaattcagctataacactcatttctaccacaatttagtaagccaactcgacccatcgctcagtt

SEQ ID NO: 68508 - DNA, 201 bp, Homo sapiens
aatccagagtgagaaaatattgaggctcagaggagggaaatttcaaagccagatgttttggtgctgactttgggactggattctgagttttcttttgagamctttgccactttccctgtagtgtgttggtgtccgccttcaatcccataagctcggttgagaatgcctgtattagggagtgacttcatcattaactccagc

SEQ ID NO: 68509 - DNA, 201 bp, Homo sapiens
tgcccaatttacagatgaaaaaataaatgtcagaaatgttaataagagacatatctaggatcacacagctgataagtggttgaactagaaattcagccccrtgtgaggctgaaatcaaatcttgttttttcactgtagtttttccaggctatgccaacttatctagaaattacaaaattagaagggcagttgttgatatgg

SEQ ID NO: 68510 - DNA, 201 bp, Homo sapiens
aaaaataaatgtcagaaatgttaataagagacatatctaggatcacacagctgataagtggttgaactagaaattcagccccgtgtgaggctgaaatcaartcttgttttttcactgtagtttttccaggctatgccaacttatctagaaattacaaaattagaagggcagttgttgatatggagagtaaggcatcagtga

SEQ ID NO: 68511 - DNA, 201 bp, Homo sapiens
acctgatgaactttgcctccatcttattcatggtaatttccttgagggaccacttgcctgtgactgcatgcatgtagatgctgttatgtgactactgtggrtattatattctgctatggaaataatgagcggctggtaaaggggaagccacagtcctgtgtagaggggcaggatcttgtctgatagtgaggccattgacca

SEQ ID NO: 68512 - DNA, 201 bp, Homo sapiens
atggtaatttccttgagggaccacttgcctgtgactgcatgcatgtagatgctgttatgtgactactgtggatattatattctgctatggaaataatgagmggctggtaaaggggaagccacagtcctgtgtagaggggcaggatcttgtctgatagtgaggccattgaccacccatgctagaatttggaacttccaggga

SEQ ID NO: 68513 - DNA, 201 bp, Homo sapiens
tttggttgaggttaattctttgccccacagccaccaaagagtcttcatctgagaacatctaaatggccaacttttggagatcagggggaaaaaaggggtgractaagtaatgagcatagttctgaaaactgttttattttttcaaggtaaaatttggtaacgaggagcttaaacaatttttttttccttctgggtcatgaa

SEQ ID NO: 68514 - DNA, 201 bp, Homo sapiens
gcacatgcatgcgtgcgcacatatgtgcataagtatatgtaagcactcatgtatgaattttcctgaatcttttccaaagacagaaaatttagaagctcttmcaccatgcttccataatatcctggccatggctatatcacaactactccactgcactgtaactgtttcatagcccatctatctctgttagaacactaagca

SEQ ID NO: 68515 - DNA, 201 bp, Homo sapiens
accatgcttccataatatcctggccatggctatatcacaactactccactgcactgtaactgtttcatagcccatctatctctgttagaacactaagcatmctggaccacaaaggtcatagcccagtccccacaacaccatgaatgcttataaaatcattgtaaaatgattcttctcaattgtctaggcaagtagggccac

SEQ ID NO: 68516 - DNA, 201 bp, Homo sapiens
tcgtaagaattggagataaaatacatcacgcacaatctggtttgtacagtgcctcacatttaatagacagagagtcataattattattcccattcatagtrgtgattgtagtaaaatggaaaaccagaactttgtgtgccttggcttactgcaatagctgaaatttatagtggtacattccctgataacagacatgactct

SEQ ID NO: 68517 - DNA, 201 bp, Homo sapiens
tcaggatgataagagatgtttcagctcacagctgtacactggccctatgaaattcggcaacaggaattgccccgcgttccctcctcaccctgaccaactcsttcctttatcggaactgtttttgatagttcagtacatccagaaagaaaaatcaggagaaattctctgagtttgttgttgtttatttattttattttattt

SEQ ID NO: 68518 - DNA, 201 bp, Homo sapiens
acttgggcttctgtggaaggatggaatgaagtgaggcttcctccctccttcctaactggctagacctcccccgttccagaagggcccatgtcttggacttygaacaaaaatgagagcaatgaaaccaaagctgccccccgcctctggtgtgcttgacatggaaggatggaatgaagtgaggcttcctccttccttcccgac

SEQ ID NO: 68519 - DNA, 201 bp, Homo sapiens
ctcaggatgataagagatgtttcagctcacagctgtacactggccctatgaaattcggcaacaggaattgccccgcgttccctcctcaccctgaccaactmcttcctttatcggaactgtttttgatagttcagtacatccagaaagaaaaatcaggagaaattctctgagtttgttgttgtttatttattttattttatt

SEQ ID NO: 68520 - DNA, 201 bp, Homo sapiens
aatggtggagtgactgccgtggtcacagagttagctcatgggaaaggtgggctgagatttggtctcctgactcctgttcagtgcgattgttagggcatcaygagtgtagactgtactgtccctgcactgtttaatttaatatttaatgccagggtaatgctttcagtattcccaccaaagggattagtggaggaaaaaata

SEQ ID NO: 68521 - DNA, 201 bp, Homo sapiens
gctcaggatgataagagatgtttcagctcacagctgtacactggccctatgaaattcggcaacaggaattgccccgcgttccctcctcaccctgaccaactccttcctttatcggaactgtttttgatagttcagtacatccagaaagaaaaatcaggagaaattctctgagtttgttgttgtttatttattttattttat

SEQ ID NO: 68522 - DNA, 201 bp, Homo sapiens
gcctggagtgcaaagagatgatgtgttgactccctgggtgggggtgggggtggggggtggtgggaccagagtgggaccagggactggaatgtggggcaggmtgcagagtggagaggctcgctcagatgaaggcactactgtgtcaccattggctcctgggtcctggctccaggtggggagaagcagtttctctttctgggg

SEQ ID NO: 68523 - DNA, 201 bp, Homo sapiens
gaagcagtttctctttctggggcaacaaataaaatccctccgagcacaggagtgctcattgctggttggttatgccagtctgtctctatttttagaaagarctacaagagggaggaaaagaatctagagaaataagtacagatggattcctccctgaggcagaagctggggtctgtgggatgaagcacagacacaaagcca

SEQ ID NO: 68524 - DNA, 201 bp, Homo sapiens
ttcacaacaacgacatgaggtagatatgaccgttagcttcattttatagatgagaaaattgaaactcagagaggttaataaacttatccaagggcacacascttgaaggagatagtcagggactcaaaatcatgtctgtctgactccaaagccacgctcctgctctctcactttactgaaaaatccataactggacttgag

SEQ ID NO: 68525 - DNA, 201 bp, Homo sapiens
agcagcccctgggtttgtgctgtagaaaacattgcccatcattaactgggtttccttatcagttggggccacagggtccctggtggataaagcaatgatgrtgatgatgctgctgttgctgatgatgattttaatgatgataatgatgttgatgatgatgatgatattgatgacaaggataatattgatgctgctgatgat

SEQ ID NO: 68526 - DNA, 201 bp, Homo sapiens
ctgttgcaaaatgcactggcagcagcattgtagtgggcagtacagccagcacaggccagtctcagccccctggatccccaggctccattcagtttcaggcyggctggtctctacatgctgcacattcctctctgcacctgtgttcatccacttcttctcttccatgccgctcacaacggcatgtgcaaatctcatcatgta

SEQ ID NO: 68527 - DNA, 201 bp, Homo sapiens
gaatctgctgtgtctgccctgcctcctccctggtgcttttgctttttcttttttttttaactacatcctcaacacagccacttgcagccaccaccgtctcrccactgcctcatttattccttccgaggtgtagtgttggtcatatccctccggtgtccaaaaaccatcagggttcccgtgctcctagcgaggccctcccag

SEQ ID NO: 68528 - DNA, 201 bp, Homo sapiens
attccttccgaggtgtagtgttggtcatatccctccggtgtccaaaaaccatcagggttcccgtgctcctagcgaggccctcccagagcatccttctcgtytatttaatcctaggtccttctccatgtcctgtggtccaggaaagtgaatcctccgcaccctacagctccctcctgccctgcctgtcctgagtgctctccc

SEQ ID NO: 68529 - DNA, 201 bp, Homo sapiens
tatttaatcctaggtccttctccatgtcctgtggtccaggaaagtgaatcctccgcaccctacagctccctcctgccctgcctgtcctgagtgctctcccrgccctgggcttgcctgcgccttctcatgcgtgcatccaaagccacctctcgtgtcacctgctccttaccacctcccccttccccctgccccacaggattt

SEQ ID NO: 68530 - DNA, 201 bp, Homo sapiens
gttaggttaaagaatattgccacggtcatataacaggccaggcagttgcaaagccagcgtacaatgcactttctctgaccctcggccacccttctttccayggcatcccgaatctcccccagaagggcaccgtgtcaacctagaaagagcttgaacccttaagcaaggtcaaagactcttcctcattcccaagccacaggg

SEQ ID NO: 68531 - DNA, 201 bp, Homo sapiens
ttgtactgtcttatatgctggctataggatttttaagcagagtatatttaaattaaggatattttgctgcaagtcttcgtattgttaatgtatccgtgaayggagagttttaattggcttccattattagagccagattattataagtaaagactactttactcactgtcatctttactagtgactttggcagcttggaag

SEQ ID NO: 68532 - DNA, 201 bp, Homo sapiens
ccaagagatggccatgacattaatcatcactgtcccctaccccaaaatggggcttcaaagctccattgccgcaggcccctcacagccctgtcatggggttwtcctcagggctgatgagaggaaattcttcatttgctttaagagctgcaagcttaagttctctggacacttgcagccatttgacttttcctcctgagcaga

SEQ ID NO: 68533 - DNA, 201 bp, Homo sapiens
ggaggtgctaactctggaggcaagaggattgggtgctttcatgggaagggtaagctcaggatgttaagttacttacgtatcttacagagccttcaagtttrgggaactggatcagggtgttgcagggagggaggtgatctgtaatttaactaggcttctacatctctaatctctttagaacaaacctctgagacaagatgt

SEQ ID NO: 68534 - DNA, 201 bp, Homo sapiens
aatgagcattttttctttaagttgctttgagaggacatttaatttggttgctttttagttatgtctcatttttatgcaaaatagtaatgccaccttcctamtctggtttagcttagaagtgcttttccttgtttccttggtggtctctgagctcctcctgggcagagctgaaccttctcctcagcgtgtcctcagtatcta

SEQ ID NO: 68535 - DNA, 201 bp, Homo sapiens
ccatgacattaatcatcactgtcccctaccccaaaatggggcttcaaagctccattgccgcaggcccctcacagccctgtcatggggttttcctcagggcygatgagaggaaattcttcatttgctttaagagctgcaagcttaagttctctggacacttgcagccatttgacttttcctcctgagcagaaggatgtaggc

SEQ ID NO: 68536 - DNA, 201 bp, Homo sapiens
ccttcctaatctggtttagcttagaagtgcttttccttgtttccttggtggtctctgagctcctcctgggcagagctgaaccttctcctcagcgtgtcctyagtatctagcacagagcctggcccattggcactgttcagactgtgtctgttgagtgggactgaaccaagactccagggggactcaggaaaagtccctccc

SEQ ID NO: 68537 - DNA, 201 bp, Homo sapiens
agaattgtattccatcaaaatcttctccaccaatcctggcaagtccattctattttatctactatactgtttgtgttctctaaacagattgtcttgaaacrtccttgttgaatattgtcttggttagtttaacccactcttccttgttattttaacctaaactcaggaaatcactgatgcagaaatgtctccagcttcagg

SEQ ID NO: 68538 - DNA, 201 bp, Homo sapiens
aaaactttagtgtgtgagtgaaactaagaattaatactgaaggaaaatgaaagaagctctactccctcttgatgtttggccttatctggaagaatatgaaygagtcttgttctaatcccatcagaaataggttcatatgttcttatttcttcaggatggccacaagatgtagttaccttgttctcattgtgtgatggaaag

SEQ ID NO: 68539 - DNA, 201 bp, Homo sapiens
accttaagtttgtgtctgtttagcatataagtatacagtatacattgcagtcatctgtacatgttgatatttattccaataagaataaaattacacataawagataccatttattaaacagttattatgtatccaacattgtacatattgtacattgtatgtacattgtacatattttgtatgtaatatcatttacccttc

SEQ ID NO: 68540 - DNA, 201 bp, Homo sapiens
ccaggaacatatcagccagctcagtgcacacaaagaaagccacagcccttttcccttgggaggcaaacagtgatttgactctgacctgatttcctacccasatcacataaaatggctggaaggtgtgaggtgaggcagagcaaatcagcccactgcattttgaatgttgtgatgtaggaagtgcacatctcgaggcttaga

SEQ ID NO: 68541 - DNA, 201 bp, Homo sapiens
gaaaatgaaagaagctctactccctcttgatgtttggccttatctggaagaatatgaatgagtcttgttctaatcccatcagaaataggttcatatgttcytatttcttcaggatggccacaagatgtagttaccttgttctcattgtgtgatggaaagcctgttgggctaagagtctagcaaccggattctatcactaag

SEQ ID NO: 68542 - DNA, 201 bp, Homo sapiens
catagagagagacttgggctgctggtggcagcggaaggggcggtgtggagtcaggaggtcttgggggatactagtcagcaggacccaagtctgttggctcmcctgtaggtcggacttcaaactccagggtatgttgggaaagagagtgaagtcctactgaaaagggaaggaaagagacagggtttcagaactcttttccga

SEQ ID NO: 68543 - DNA, 201 bp, Homo sapiens
ggcttgctcaacagcaatgttagatatctcagaagtggtttaatccttccagcaccaaatggtccaaattgacttagcatgctttgctgcagtggttgacrtgtgctcttttgacagccactgtctggtggacttattatacttatacacatcaaagatggaaaaggcatgtgactcagctgcatgagctcagggacctga

SEQ ID NO: 68544 - DNA, 201 bp, Homo sapiens
atgctgccctgtggttgggtcgtatctgtcatttgtccactgctttactatattcacatggttctcactcaaacaaaacaaagaaaactgtcctgtgtagyaggcagggcaggtatcactaccgtgcccaatttacagatgaaaaaataaatgtcagaaatgttaataagagacatatctaggatcacacagctgataagt

SEQ ID NO: 68545 - DNA, 201 bp, Homo sapiens
ctttaggccagattgtctacaaattacaattaaaaataatagtaatgcctctcattaccatgattattatgattagtggtgctgtgctgggtgggcctggktcagggcccaggtctgctgggaataaggctgggaagaaatggctgtacatagagagagacttgggctgctggtggcagcggaaggggcggtgtggagtca

SEQ ID NO: 68546 - DNA, 201 bp, Homo sapiens
tggtctggttgagaagaaaataagcagaacagataggaaatagcaggttatttggtgagcttatgtatggaccatgagcattgtgggtgctcagaggagarggagattacttgagggactagaatggaaagggtgggcctcctggaggggcagctaggtgttgtaagagagaaaagaaaaacattctaggtggggagtcgt

SEQ ID NO: 68547 - DNA, 201 bp, Homo sapiens
tagaagggcagttgttgatatggagagtaaggcatcagtgactagaaatatatctatatagagtgataatgatcaatcgcatgcaaatatatgcaaatgaragcaaattaatatctgttatttgtgcctcctgattgtctctactctcccgtttctccccaggatgatgaagataaactgacctggaaggatcgtttccca

SEQ ID NO: 68548 - DNA, 201 bp, Homo sapiens
caaagaaacaaatacctgggcactagagctgcttttaccttgagaacattttcccatctcggcaaacctaggctttggttttggtggttttatgggagcarggaggatagaaattagggttgatggatggccccaaatggggattgtaacaggatgtcctcaccaaattaaatcagaactccaaagggctatgttcagagt

SEQ ID NO: 68549 - DNA, 201 bp, Homo sapiens
atatctatatagagtgataatgatcaatcgcatgcaaatatatgcaaatgagagcaaattaatatctgttatttgtgcctcctgattgtctctactctccygtttctccccaggatgatgaagataaactgacctggaaggatcgtttcccaggttacctgatgaactttgcctccatcttattcatggtaatttccttga

SEQ ID NO: 68550 - DNA, 201 bp, Homo sapiens
tgagaatctcactatgcctggggtcccacaactgccaccagcaagttccgggaactgaaccatgtgggcaggagctgggagcagagtggtgggaatggggrgagccccctttacacatcacccttcacagtcaggtgctcaagctcgtccaggcttaagcttccagaccagggagaattattaatagcacttcttctttac

SEQ ID NO: 68551 - DNA, 201 bp, Homo sapiens
ggatccctggcctaccagatctgggtttaaatccaggctttacaatatactcactgtgtgaccttggcaaagttattctagaaatattgccatctaacttaaaaaaaaaaaaggtttttacgttaaaacaaaactaaactaaaaaccagcttggataaatgcttagctatccagaaaacataaaatgtggacatcggagga

SEQ ID NO: 68552 - DNA, 201 bp, Homo sapiens
gggttgcgagatggtgcttctgcatggagacagaccaaaaacttggagaaggaatcaggtaagatggctgcaattgcagcagcctgtttgggctgtggggyggccctctctgacgtttgtggatagaccagggtctggaagccacaggagatagccagcttgggctcggtaagtgtgatccttccgctttcctgtagttgc

SEQ ID NO: 68553 - DNA, 201 bp, Homo sapiens
ttgtgattgtgtgtggtggggcagttcatatccaatagcatccaatcctaaacgctgacgttaatgtacatgtgtctggttataaccctaaggccaaggtsattcttccttttgtttactaaccactcactgctctttggtttaggaacattccaggcctgagtatgaaaccaaagttcgagagaaaatgctaaaggagag

SEQ ID NO: 68554 - DNA, 201 bp, Homo sapiens
agaccaaaaacttggagaaggaatcaggtaagatggctgcaattgcagcagcctgtttgggctgtggggtggccctctctgacgtttgtggatagaccagrgtctggaagccacaggagatagccagcttgggctcggtaagtgtgatccttccgctttcctgtagttgctgggtttatttccttgcgctttaccttagag

SEQ ID NO: 68555 - DNA, 201 bp, Homo sapiens
ctatttgcacactgcccctgacagatcatcagcatgctaacttttaaaacctaaaccaactcacatcactcctctgctcagaactctctgatggcttcccrtctcctgaggtgtggaagcccacatcctcacactacagggccccctcctggctgcctgcccatctcccactcctcctgtccccttgctcactcagtgtca

SEQ ID NO: 68556 - DNA, 201 bp, Homo sapiens
tggaaaacccaaacaccgcatgttctcacttataagtgggagctgaacaaatgagaacacatggacacagggaggggagcaacacacactggggcctgttrggagatggaagggggtagggagagcattaggcaaaatatctaatggatgctgggcttaatacctaggtgatgggttgataggtgcagcaaaataccatgg

SEQ ID NO: 68557 - DNA, 201 bp, Homo sapiens
ggctttggattaattaagaaagccctctgattagagtagagaggggtgaccagtcctgctggtgatgggttgtccttgcttcggcctcttgtagcactcarccagcctttgcctcccgttctccagttcaggccaggcttccttccctttgctaatttcccaaagcactgcacattccaaagccatccccattccccaaga

SEQ ID NO: 68558 - DNA, 201 bp, Homo sapiens
cttgtagcactcaaccagcctttgcctcccgttctccagttcaggccaggcttccttccctttgctaatttcccaaagcactgcacattccaaagccatcyccattccccaagagaatgggtgagctcagccccactgctcaggtcccgatttggagtacggttttggcatattttccatcacagttgttgtttctaggtt

SEQ ID NO: 68559 - DNA, 201 bp, Homo sapiens
ttcttttgcactttcttccccaccattgtctctgtcttctctttctgattaagtgttggagtttcaggccgggtgtggtggttcgtgcttgtaatccttgwactttgggaggcctaagtgggtggatcatctgagcccaggagtttaagaccagcatgggcaatatggtgaaaccctgtctttactaaaaatacaaaaaat

SEQ ID NO: 68560 - DNA, 201 bp, Homo sapiens
tcaatggtcttgtcagattttacaggatgttcatgatgctaattcagcagtccttataatatatacctttctttaatgcttttaaatctcaacacaaggtyaaggcaaagtcaggagagggaaccagtgtgggacattggacctgacctcctggtgttgttgttgttgttgttttggcagtcctgtatttgctgtgtaacc

SEQ ID NO: 68561 - DNA, 201 bp, Homo sapiens
atattagctgggcctggtggtgcatgcctgtagtcctagctacttgggaggctgaggtgggatgatagcttgagcctgggagacagaggttgaagtgagcygaaatcacaccactgcaccccatcctgggctatgcagcaagactcttgtctcaaaaaaaaaaagagttcctagatcaattaattttttaatgttttcttt

SEQ ID NO: 68562 - DNA, 201 bp, Homo sapiens
gagggtgagaacatagtataaagcagccatctctgggtttctctccccactttgcattttggtagacacagcactagtcgagtcctcagaagaagagacttctaaccttggttctgcagttattcgttgtgtggtttggggacgtcatcccatctctcagagcctcagttgcctcatctatgatatgggcatactcatacc

SEQ ID NO: 68563 - DNA, 201 bp, Homo sapiens
gagggtctggaccagctcgaggcctttccagtagcatctaggtcttctcaaagcagggtctaaagctcacatctctctaagagcgcaggtctccacctccrtgtccaatgggaggcagcaccagtgtgacttgtcgtgtgggaaagccaggctcacatcgtctgtttctttagttgctctagaagcacttgtcctcagagc

SEQ ID NO: 68564 - DNA, 201 bp, Homo sapiens
gagtagttactgttcccgggtacctgggtttcagctttccaatcgagagatgctatgtacagttggttatgcctggtcggcttcaatcattttgttatctkcctggctcctgtgggcattggaatttttaaccttgctactgtttctcttaaatggtataattctttttctttctttgtttcttgcattcttactttaatg

SEQ ID NO: 68565 - DNA, 201 bp, Homo sapiens
tgcctgctgtgtgaacttgactgggtcactcaattctctggagatttagaaagcagaggcataacctctatggatgtctttctaagtcaggaattgagatycttgagataattccgtatacatatatgtgtacatggaagagagagagagagagagaagaaagagagaggggaggaggaggagaagggactatgatagaga

SEQ ID NO: 68566 - DNA, 201 bp, Homo sapiens
gctgcgtcagggaaagctcagggaaaaccctgtgattcgtatttgacttagatcaataaagtggtagcagttcattcttcgttgccagcatgggcaagacmgcagtatctgaagctagaggaccttggggaaggcaaaaatcagaggactaagttagggttactaataccccatatctctttatggaaatcttccttacag

SEQ ID NO: 68567 - DNA, 201 bp, Homo sapiens
cagccttgcttttcaaggcttactgccttgttttttggaagccttgtcttttgttagcttggcctcctgtgcttccttcagatgagaactcacctcgcagsttagtctccgactgagccagagtgttacatatgcttgacctgaactgaatgtagtctggcctgagagcagagggacaaacaagatgacctgcagggaatc

SEQ ID NO: 68568 - DNA, 201 bp, Homo sapiens
gcgctgggatacacattttgggagttccactctgtagatcagggacctaggttcggaaatggggaatgacttcctcggtctcttacaggtagtaagtggcrtagctgctccaggtgcagactagctttttagacaggctagttgtctcattattggaagtctctccttattagaaaactcaggggaactctcaaaatttat

SEQ ID NO: 68569 - DNA, 201 bp, Homo sapiens
ataatgaaaagccagtcggatgtaattgatgtaataactcccttcccttttaacattgggttttcataatggaattctttctctgtcatgtgatacttttsatcagttgtatgcagtttatggatctgtgtgaacatcatctagaggaaaaatttattgatttctttcatgtcatttttttttgctctgcattaatatgat

SEQ ID NO: 68570 - DNA, 201 bp, Homo sapiens
tggcttaccatcagttcctaacggagctacacttagcctatctgcatcgagctattttcaagtagagttttctgaacagatctctgtgttagtctttctgmagatcctcaattagatggatatgcttgttaaacttaaaacatgttttagacactgagggaggacaaagtgacatttccaaaagctggggtgagttaatag

SEQ ID NO: 68571 - DNA, 201 bp, Homo sapiens
ttggtctggatcagccttctttttggttcaagaatgcagccatgaagcaaggccagcccctctagtggccgtagtcctgaagcatctggaaggggaagaascccaagactgcctgctggtgtctgcatcttccccaacccccccggctgcagagcaccattcagggtgtctgggtctcccctacccacacagaggccacag

SEQ ID NO: 68572 - DNA, 201 bp, Homo sapiens
ggtaacctagcttaactcagttggttaaaacactgttcctcaactattctcagtccaagatgtgccaagtgcttaactcagttggttaaaatgattttctrtatttcctagatggcatccctctttctctttcatccagggggtgtctgtcaccctttccctccatccagataagggcatgtgcatgcacacccatatgtc

SEQ ID NO: 68573 - DNA, 201 bp, Homo sapiens
ggcatgatggtgtgggtaatgggggtatagggggaaggccagcagtggatgagtgttgggagatgaagtggtccagacgggtaggtgcggactcgatcatraaagaccctgtatgtcatatatgacaatttggtcttcatcctaagaagagtaggcaaccacagagtgggactaacttggtgagattgtttcaaaatggta

SEQ ID NO: 68574 - DNA, 201 bp, Homo sapiens
taacaccacatttctctttgggcaggtttaaggattaccgagagccgccatgggccccgaacccttatgagttttcgaaacagtactggtttattctgtcygcccgtctggcttttgtcataatcttccaggtgagttgctgggatagggaatagcccattcgaatccgggctgcaggagtaaggacactgcactcattgc

SEQ ID NO: 68575 - DNA, 201 bp, Homo sapiens
cacccatatgtcctctgctagggctgagatctttcacctttgctgtcaagtctgttttgcaaaacctacccaggtttccagaagcactaagtgggacttgrtggatgcacttgaggcttaagtgacaaggtgggctcatagtgtttccattgtctgtgtgaggaaggaactaagggcattgatggaactggtgttgcgagt

SEQ ID NO: 68576 - DNA, 201 bp, Homo sapiens
acaatttctaactaagaattctatgcccaagaaaaatatcatgtagtgataaggataaaataaagatatttatagacaaatagaaactgagagtttgctaycaaccgaatctctcattaaaagaaattctaagaatgtaccttggatgtgatcccatatggaagaccatggttttagaaaggaatgaagaacttttaaagt

SEQ ID NO: 68577 - DNA, 201 bp, Homo sapiens
cattgttgtcctatattcattcattgagacagtaagtgctctggggaaaaggtagtcctagcctactgtgtgcaccagcaaagggatgtggcttagcagcyaggaggaagtccactgcaagtgtgtgccaaagcctagacccaatcggggcaagctggatgcaggggttcccagacaggcagggttagccgaggtggctgc

SEQ ID NO: 68578 - DNA, 201 bp, Homo sapiens
gcacaagtatgcttttcatgttgtgggggtgcagagggaagtggagagagtggggaggggaaggggactttactgttctcgagagctacccgggacttgcycctgggggagtttcccacctgcttgctaggtggaggttatcccccttgcctgggggctggcttgtctctgctgcctgataccaaagctgatccttttcag

SEQ ID NO: 68579 - DNA, 201 bp, Homo sapiens
tggtaaatatgtgagaaaacctatatgaaccttgactgtgaaaataataatgccaattctcatgaggttaaaaaagatagaactaaaatatatgcaacaayactatgtaagttgggtggacaataaatagaacaataatgttctaaggtctttagattgtccagtcgataaactgattttaagatttatgtggaagcacaa

SEQ ID NO: 68580 - DNA, 201 bp, Homo sapiens
acttaccactatattactgcctacagtattcagtacagtaatatgccgtacaagtttgtagcctgggagcaatagactatactttatagcctaggtgtgaygtaggctatatagcatctagatttgtataagcacgttctgtgatgtttgcaaagtcacctaatgatgcatgtctcagaacatatccccatcgttaagcaa

SEQ ID NO: 68581 - DNA, 201 bp, Homo sapiens
tatgcttttcatgttgtgggggtgcagagggaagtggagagagtggggaggggaaggggactttactgttctcgagagctacccgggacttgcccctgggkgagtttcccacctgcttgctaggtggaggttatcccccttgcctgggggctggcttgtctctgctgcctgataccaaagctgatccttttcaggatggga

SEQ ID NO: 68582 - DNA, 201 bp, Homo sapiens
aggcatattcatacaattaaatactacacagtcatgaaaatgagcaaactaatagctatgtataacatcaagggtgaaaaaaacaagatgaaagaatatayacagtttgattctactcatagagagttcagagacaatactcaactatattgtttaaggatgcatacctctgtgttaaaactatcaaatgagcaagagaat

SEQ ID NO: 68583 - DNA, 201 bp, Homo sapiens
gtttctgtttgctggattctgtatgttttcttccttgctttatatccttggttggtgaaattcatcctccaggagcttcatgagaatggatgcatgcataraaagttcatttttttgaaaccttgcatacttaaaagtgtctttagtctgtctttgactttcgtctatactttggctgggtataggagtctatgctgaaaa

SEQ ID NO: 68584 - DNA, 201 bp, Homo sapiens
tgcctgataccaaagctgatccttttcaggatgggaagcagccagctggttttaagagaatgctctcttctgcccttgaggggagtgctgctccagcggtrggactggggaaatggccagccctctgtgggcagatcagctatttccagaagccaggcaggcaggagaagcctacgtcaccattctgttggacgagccagg

SEQ ID NO: 68585 - DNA, 201 bp, Homo sapiens
gagagatgtaatgatatagcctttctccacctcccatgggttctcacttaattgcatccccatcccactccaccccactgcattaccatatattgggtacmcactctactctagtcctaggtatttcgcatataccctgaggctaatactatcatgaactctgtggtgaaagagagaatatacatatgcattctgccttca

SEQ ID NO: 68586 - DNA, 201 bp, Homo sapiens
attttttgtagaggcagcatttcgccatgttgcccgggctggtcttaaactcctgggctcaactgatctaccagcctctgcctcccaaatgttgggattayaggcctgagccactgtgcccagccccaggctcttcctgtggcttctcttctctgttccagttgggcagaggtggcatggtgagggcagtgctgggagtga

SEQ ID NO: 68587 - DNA, 201 bp, Homo sapiens
gaggctttgagactatgcgcttctgacaatcattgcccagctagaggttgcaaaaacctccttctccatccaccaccacagcctgctcagccatgctctakctggtgagaaggggcttactgtccaaatcattgcagtcctgtcactgaatggaccccacattatttccaagcattactttaactttcataaagaataaag

SEQ ID NO: 68588 - DNA, 201 bp, Homo sapiens
cccaaatgttgggattataggcctgagccactgtgcccagccccaggctcttcctgtggcttctcttctctgttccagttgggcagaggtggcatggtgarggcagtgctgggagtgaaggaaaggacttgatctgactgggagggccaagctgtcttgggaccttgcccctcccatccttccccaccatggagactcgtg

SEQ ID NO: 68589 - DNA, 201 bp, Homo sapiens
ttgagggaccacttgcctgtgactgcatgcatgtagatgctgttatgtgactactgtggatattatattctgctatggaaataatgagcggctggtaaagsggaagccacagtcctgtgtagaggggcaggatcttgtctgatagtgaggccattgaccacccatgctagaatttggaacttccagggagtgggttgcgag

SEQ ID NO: 68590 - DNA, 201 bp, Homo sapiens
ggaattcagagctgctggcagtgctggtctgggctatattggtgtttgttttattcattgtgtgtgtgtgtgtgtgtgtgtgtaaaatggatttttctgcrtgttcacaataaaatttaaaaagacacaaaatacatatattaaataggttggtcaggtaagttctcattaagatgacattttatcaaggatctggaggag

SEQ ID NO: 68591 - DNA, 201 bp, Homo sapiens
tgctaccctgtaagcccccacttccctagcactcttccccagtcctctgagaatggccaggttcagagacagcccattgagcctgatgacctgaggaccargcccttctccaagtggctgagcaaatacttggagctttcttggcctttcctgccactcaccagcccaggagtggacaggactcgtgcctcatacctgagc

SEQ ID NO: 68592 - DNA, 201 bp, Homo sapiens
cagcagtcctggtgttagctgtgacccaggctgtgaaaaaccagagagcagctggcatttctggtggggctgcttgctgacagatcttggtgccacatggygagcagaggagccccagggcttggtggaggtgtgggagggacacctggcatgaagggtcccagggcatatacttggcctgcctatgccttgcctgtgact

SEQ ID NO: 68593 - DNA, 201 bp, Homo sapiens
ggtttcagcaccaggtttcctctaagatttctttaaaaaattaaaataagtaaacggtatggcgactctgttttctgaactgaaaattaggacatggacawgtgatgtggcatgagactggatgtgaaagttgatgctgttcagaaaaatacggtgtatgtggccaacacagagatgactccatggccctcctccaaggtc

SEQ ID NO: 68594 - DNA, 201 bp, Homo sapiens
acaactataactctcaaagaatttttcttaacatatataaagaattaaaaaacatggaaaacagtaattcagtacaaaataggaaaaagatgaatatgtasttcacaaaagagggaatccaaatggccaatgagcctataaaatggtacccaatctcattagtaatcctggaaattctaatttaaaccacaatgagatacc

SEQ ID NO: 68595 - DNA, 201 bp, Homo sapiens
gcgccgaagtaactgagcagaagcggctagtgagataagaagaaaaccaacaaaaagtggagtcccagggggtcatgcgaggaacatgtctcaggatgaarggagttattaacgtctcccattattgttaataaacaaggatttttacaacaaggtgattggccctcggaaacaatacttttcaatcttctttgttctcag

SEQ ID NO: 68596 - DNA, 201 bp, Homo sapiens
tgttccctcaaaccccatagttaatccactggtaagtgcctttgactctactactaaaatctatccttgctctgaacatctttcactctgttcatactgcraacctagtccagatccccagcagttcttgccaggggtattgcatcatccgcctgcctgctgtatctggagcctcattcccttagagtctagtctccatac

SEQ ID NO: 68597 - DNA, 201 bp, Homo sapiens
aatgccagaattataggtgtgagccactgtgcctggcctgcattcactcttctttctgttcctcccacacaccagtgcatatccaccccagggtctttgastggctcttccttcttctggaaggctcttactcaatgatggctttggctacctgctcctcactctgccctctcctcatcaccatctcagccctggctgcag

SEQ ID NO: 68598 - DNA, 201 bp, Homo sapiens
aaagaggaatataggaattttatacactgaggttcatctaaggggagctctggaaattcctgtccatggtatctagttagcaccacagaaaataggggttwaagaaagatgctgatgatgtgggtagtggtcctgcagggttgacaggtttggctgacagcctgtaagagcacaagtatgcttttcatgttgtgggggtgc

SEQ ID NO: 68599 - DNA, 201 bp, Homo sapiens
gggcctcactgacttgcgctgtaaactgcatgttcatctctaccttgaggatggggactgcatctttttcaatctctaagttcctaacacagggcttggcmagaaattattaggctgaattctttctatctcacaatttaatgtgtgcctttaggaaaatcctagaagacagagttgcctaagaatatttaacttcagatt

SEQ ID NO: 68600 - DNA, 201 bp, Homo sapiens
atgcctttatgatgggcctcactgacttgcgctgtaaactgcatgttcatctctaccttgaggatggggactgcatctttttcaatctctaagttcctaayacagggcttggcaagaaattattaggctgaattctttctatctcacaatttaatgtgtgcctttaggaaaatcctagaagacagagttgcctaagaatat

SEQ ID NO: 68601 - DNA, 201 bp, Homo sapiens
ccttcagcctgctgctgcactgtgggagcccctacctgggctggccgaggccggagtcggctccctcagcttgcagggaggtgtagagggagaggcatggkcgggaaccagggctgcgcgtggcgcttgggggccagcgcgagttctgggtgggcgtgggcttggcaggccccgcacttggagcaaccagccggcctgccg

SEQ ID NO: 68602 - DNA, 201 bp, Homo sapiens
ctctaaggacagtggccaggaagggcctcctgtcccacctcccaggaacatatcagccagctcagtgcacacaaagaaagccacagcccttttcccttggraggcaaacagtgatttgactctgacctgatttcctacccagatcacataaaatggctggaaggtgtgaggtgaggcagagcaaatcagcccactgcattt

SEQ ID NO: 68603 - DNA, 201 bp, Homo sapiens
ctttttacataaaaactgtggccccaaatgtgtccatctttcctctggcaaagagaaggccgaaaatttggcttcctaacccagagcctggagataccccygccacccagttggcgccctgaggatctcggctcaagtgtgggcaggcttggagccagtgtccaggcacttgtccagatctctggttggacagcccttcag

SEQ ID NO: 68604 - DNA, 201 bp, Homo sapiens
tgctcagaactctctgatggcttcccatctcctgaggtgtggaagcccacatcctcacactacagggccccctcctggctgcctgcccatctcccactccwcctgtccccttgctcactcagtgtcagccactgcctgcctgaaacacccttcccttaaatccttcctttaggtatttggtaaaaggtcactttctcagct

SEQ ID NO: 68605 - DNA, 201 bp, Homo sapiens
gtgtgccaggggtggggctagggaggaaaggagggtgggaaagaaggcttttctagataaggagaacagtgctccttgaatttgaaaaagaattctgttamaatgcaggttccaggtcagtaggtctggagttgtgcttgagattccgcatttcaatcaagcttccagctgatgcagctggtccttggaccacatttttga

SEQ ID NO: 68606 - DNA, 201 bp, Homo sapiens
gtactcatggtcaccaccactcctctgtgctttctcttgagtgtggaaaagaacaactcagcatcatcttgtccttccgtctgcttccaaataagatcaarctttacccattccacccagatgagcatctgttttgaatgctcatagatatctgctagatggttagctccttaaaggttcagatccacagtttatcccttc

SEQ ID NO: 68607 - DNA, 201 bp, Homo sapiens
agtgcttgtcaaccagtggtgatggtgagccctgactcgggcagtcctgggatacctgcccaaatgaataaggggtgaaagaagaggacacaagggtggcyccctttgggaagagcagaagttgaggctctcgttccttcccttctgtcttcactccttccctaccatcaatgtttctctactgcatgatgaacaaagatg

SEQ ID NO: 68608 - DNA, 201 bp, Homo sapiens
tatttcttggcttgcagggcatgacctgagctggggggcagaaagttcccaggacattggaactgaacagcatgaactgcaggagctcttagccttgcctscagcccgaacccttgactgccataagcacagttctttttatctcagacccattactacccaggcctccagccccattgtcaccactgacctcccatattc

SEQ ID NO: 68609 - DNA, 201 bp, Homo sapiens
tgagctggggggcagaaagttcccaggacattggaactgaacagcatgaactgcaggagctcttagccttgcctccagcccgaacccttgactgccataakcacagttctttttatctcagacccattactacccaggcctccagccccattgtcaccactgacctcccatattccccaccctttgcctagccctccagcc

SEQ ID NO: 68610 - DNA, 201 bp, Homo sapiens
cctggcccaaggcttccctggccactcgctggctatcgtctccaatggggagacaggcaaggagcctcatgctgggggcccaggtgacattgagctgggaycgctcgatgccctggaggaggagaggaaggagcagcgggaggaatttgagcacaatctgatggaggctggactggagcttgagaaggacttggaggtgag

SEQ ID NO: 68611 - DNA, 201 bp, Homo sapiens
ctgcaggagctcttagccttgcctccagcccgaacccttgactgccataagcacagttctttttatctcagacccattactacccaggcctccagccccaktgtcaccactgacctcccatattccccaccctttgcctagccctccagcctgagagagctggggtggaggagtaggagagagagacagacagagagagag

SEQ ID NO: 68612 - DNA, 201 bp, Homo sapiens
aagttgaaaaaacaaaaacactttggatatagtttggcattatctagtgaaactgaaagtacatatatcctggggcccagaaattctactcctggatatcygtcttagaaaaacttgtgtacatgagcagcaaaatacgtgtacaagaacgtctatggaagccctgcttataataactcaacctggaaacagtccaaatgc

SEQ ID NO: 68613 - DNA, 201 bp, Homo sapiens
gagcctgtgtccttggaggcccgtcttagccgcatgcacttccatgacagtcagaggaaggtcgactatgtacttgcctaccactaccggaaacgcggggygcacctggcccaaggcttccctggccactcgctggctatcgtctccaatggggagacaggcaaggagcctcatgctgggggcccaggtgacattgagctg

SEQ ID NO: 68614 - DNA, 201 bp, Homo sapiens
attactacccaggcctccagccccattgtcaccactgacctcccatattccccaccctttgcctagccctccagcctgagagagctggggtggaggagtargagagagagacagacagagagagagagagagagagagaaagagaaagagagagatagatagatcagagaatatagtttataactcatcaagagtctataa

SEQ ID NO: 68615 - DNA, 201 bp, Homo sapiens
agttgtctctccttcttctatcccctctaagaggctttactcagggcacttgcttctcatagcatccttgtgcttcctggaaatgatccttccttggttgsgatggggacaggaggggacgtggggacagaagaaggaagaggggctgttgggcagatctaggtctaagagagtcccttcttattcttaggttctagagag

SEQ ID NO: 68616 - DNA, 201 bp, Homo sapiens
accagcccaggagtggacaggactcgtgcctcatacctgagccaaggtgggcataggatgttgctgggtcacatgagtctctgctgtgtctggaacaaaargaactctgacttcttgagaacctactatgtgcctaggaactagaccatttacctacattaggtcattacagtaggttaatgacatacattgcatagagga

SEQ ID NO: 68617 - DNA, 201 bp, Homo sapiens
cactttctcagctgtctctttcccaaccaccctattttaaattgcaaccgatccctataccctgtttgccttctttgtctccacggtatttctcgtgctgraggtactacttattttacctatttattagtttattgtctatgttttcccactagaagatccactctgtgagggtagtgctttctgtttcctttttccact

SEQ ID NO: 68618 - DNA, 201 bp, Homo sapiens
ctctttccaggcatgtgcatatttgtgaacgttatctgtgtttcttcataagcatcttgagaaaaataagcagagaattttaattcagcatatttaatgayagacaggattctatggaagcacttcggaagaacatccaacactcctggggactcaggaggctttggagggagaggcgtttgactggagagcccagagata

SEQ ID NO: 68619 - DNA, 201 bp, Homo sapiens
aaaacagcagctcaccaaaacaggtcatgtgcttgagtctcccaggctaataagcagtagagccagaatttgcacccaggacccctgactccaacacctgygctgtgaaccactgttttagcaccagcttctctctgggatctctatagggaagatgaaaacaagtaaacaatgtgggctgcattctcaagggagtcgtga

SEQ ID NO: 68620 - DNA, 201 bp, Homo sapiens
gccatcaagtctcctccacgcctggccccaactccaaaaactccttaaggaccttgtctcctgggacactctgctttggcctcatcctggtgggatattgrctgcaccttgggcactctgcccttccccaaatcttctgtccagtgaccttgatgtcactgagacaaaagtgaaattcatgattcataaaaaatgtgagtg

SEQ ID NO: 68621 - DNA, 201 bp, Homo sapiens
atgtttttgagcaagactttgaaggctcgctcaaagacaagtagagttgctgagaagaagttgtactctgtggaggactgacatttctagatggacagccrctcactttcagccaagaccacttgtcctcccactgcccccagagaagggcagctccccacagagtgtccgaggtccatgcactgacttcttgtactcatc

SEQ ID NO: 68622 - DNA, 201 bp, Homo sapiens
tgaaatgctgcctgttgctctgggtttacctggagtctctttcctgcttagcaatcacctccccacatggagcagaaggcagtgctctgtgcaaatccctktgtgcaggttgtgtggcaggaaccaatgtcgggaggagagaggacactgctattaccagggcctggaactagtacccatgttcccctttattctgctttt

SEQ ID NO: 68623 - DNA, 201 bp, Homo sapiens
ccgctcactttcagccaagaccacttgtcctcccactgcccccagagaagggcagctccccacagagtgtccgaggtccatgcactgacttcttgtactcrtctgtttcccccactgcatgatcgacttctccatggcagagaccttctcctgctcattagtagattgcctgtgtcaagcccatggcagggactcaatgaa

SEQ ID NO: 68624 - DNA, 201 bp, Homo sapiens
ggagcagaaggcagtgctctgtgcaaatccctgtgtgcaggttgtgtggcaggaaccaatgtcgggaggagagaggacactgctattaccagggcctggarctagtacccatgttcccctttattctgcttttgtctcgctttgagcttggggcagaggaactcttctgctcttccctgtacaacaggtctgtcatgcaga

SEQ ID NO: 68625 - DNA, 201 bp, Homo sapiens
tggtcaccaccactcctctgtgctttctcttgagtgtggaaaagaacaactcagcatcatcttgtccttccgtctgcttccaaataagatcaagctttacmcattccacccagatgagcatctgttttgaatgctcatagatatctgctagatggttagctccttaaaggttcagatccacagtttatcccttcatttctc

SEQ ID NO: 68626 - DNA, 201 bp, Homo sapiens
ctgttaaaatgcaggttccaggtcagtaggtctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctc

SEQ ID NO: 68627 - DNA, 201 bp, Homo sapiens
tctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctcccacaagaccctaaacaaaggatgtttttg

SEQ ID NO: 68628 - DNA, 201 bp, Homo sapiens
tgagttaatttttgtacaaagtgtaaggaaggactcttacttaatttgctccaaatgttacacatatgtcaatgctgtctgagttttagaggtcgtgtcayacttttggcttatgccgagttcagattcaactggctccctgaatgcttgtccacctgagctggcattgatgtgagctatacccactcgcgtgcttttctg

SEQ ID NO: 68629 - DNA, 201 bp, Homo sapiens
ggtcgtgtcacacttttggcttatgccgagttcagattcaactggctccctgaatgcttgtccacctgagctggcattgatgtgagctatacccactcgcrtgcttttctgaacctaaatgtagagccttacagttgacccgttcaaatgtcccttgttaagttcagccaaccttgctaggcacctgagatcttcacggat

SEQ ID NO: 68630 - DNA, 201 bp, Homo sapiens
actggctccctgaatgcttgtccacctgagctggcattgatgtgagctatacccactcgcgtgcttttctgaacctaaatgtagagccttacagttgaccmgttcaaatgtcccttgttaagttcagccaaccttgctaggcacctgagatcttcacggatatacctgctgccaagcagtgttttatctgctttccaacct

SEQ ID NO: 68631 - DNA, 201 bp, Homo sapiens
tattaatgtataatctcttttgaatttggtagtgttcaagatttgatattcagttttggttttcagtattttgactctgatgtatctaggtgtggttttcttttttttttttaacttgagtttgctggacttcttaaatctgttattacaagttattgtattttatcaaattttgagacaatttcagccactatttattca

SEQ ID NO: 68632 - DNA, 201 bp, Homo sapiens
aattcaaatgctaaattttgctaaatgtagttaacttgtgcctaaatgatttgatccagtttataggtgtactggaggcatgcccaccttccatatcaaasgggaaggcaagcatctttctctaaattgacaacatcgatatgtggcattccaggaggagcctcaagaagcaacagaatctgttggccaactactgtcaca

SEQ ID NO: 68633 - DNA, 201 bp, Homo sapiens
tgcctaaatgatttgatccagtttataggtgtactggaggcatgcccaccttccatatcaaacgggaaggcaagcatctttctctaaattgacaacatcgrtatgtggcattccaggaggagcctcaagaagcaacagaatctgttggccaactactgtcacacaagctcaccatccatccatctatccatccatccatcc

SEQ ID NO: 68634 - DNA, 201 bp, Homo sapiens
taggcaaatgacctggatagacatttctccaaagaagacataaaagtggccaacaggtatatgaaaaagtcctcgacgtcaccagtcattagggaaatgcraatcaaaactacagtgagatatcatcgcatacctgttaggatagctaatataaaaaagtcaggagataactcttttggaaggaatgtggagaaaaaggag

SEQ ID NO: 68635 - DNA, 201 bp, Homo sapiens
ttctttgggaggttggggtggggatgatatacgtgcagtatttcacatctctgttcgttcattgcagacccatttaacttcccaggtattgtataaaacaytgggaattaaagctaaacagaatgtggctccttccatcaaaccctgggtaatcacaaggaaggaaggcctataaggaaagaaggcagacgagtgaggaaa

SEQ ID NO: 68636 - DNA, 201 bp, Homo sapiens
ctagtaaggaaggaagactggtaagaaagtgactaataaggaaagaaggcagacgagtaaggaaagaagatagactagtaaggaaggaagactggtaagaragtgactaataaggaaagaaggtagacgagtgaggaaagaagatagactagtaaggaaggaagactggtaagaaagtgactaataaggaaagaaggcaga

SEQ ID NO: 68637 - DNA, 201 bp, Homo sapiens
gtgatcagatccctggggtcaggaaaggcatgcaggaaagtggcaaatgagccacttgggtggttgggagagtcttggtcaagctaaacaccagtggaacrggagctgagctcagcgtacgggagaaagaaagcatgaagtgtacgcaggatgccaggggagcccggtgccggggctctacgtccagggcacatccagggc

SEQ ID NO: 68638 - DNA, 201 bp, Homo sapiens
ggaagactggtaagaaagtgactaataaggaaagaaggtagacgagtaaggaaagaagatagactagtaaggaaggaagactggtaagaaagtgactaatraggaaagaaggtagacgagtaaggaaagaagatagactagtaaggaaggaagactggtaagaaagtgactaataaggaaagaaggtagactagtaaggaa

SEQ ID NO: 68639 - DNA, 201 bp, Homo sapiens
caaatgagccacttgggtggttgggagagtcttggtcaagctaaacaccagtggaacaggagctgagctcagcgtacgggagaaagaaagcatgaagtgtrcgcaggatgccaggggagcccggtgccggggctctacgtccagggcacatccagggcacgatggagtgggaaactgtgctgacggagttgaccagaacgt

SEQ ID NO: 68640 - DNA, 201 bp, Homo sapiens
atttttgtattttttgtagagacggggcttcaccatgttgcccaggctgttcttgaactcctgacctcaagagatccacccacctcagcctcccaaagtgmtgggattagaggggtgatccacagtgcctggccagactccattattttaatgaatgagcagtttgcagccaccacagtgtacctagtcactcccctagta

SEQ ID NO: 68641 - DNA, 201 bp, Homo sapiens
gggagaaagaaagcatgaagtgtacgcaggatgccaggggagcccggtgccggggctctacgtccagggcacatccagggcacgatggagtgggaaactgkgctgacggagttgaccagaacgtgtttttttttttgttttgttttgctttttgatggaaaatctaaaatgccaggctgaggactccgatttttttcatag

SEQ ID NO: 68642 - DNA, 201 bp, Homo sapiens
aaagggggatatcttgggtgtgtgacatcgtgccctcccagggaggcccatttagcagagaggactgagaaaatcagaatgtcgcctcactttcttttttctttttttttcttttttgagatggagtctcactctgtcacctaggctggagtgcagtagcgcaatcttggctcactgcaacctccgcctcccgggttcaag

SEQ ID NO: 68643 - DNA, 201 bp, Homo sapiens
gcagtgctctgtgcaaatccctgtgtgcaggttgtgtggcaggaaccaatgtcgggaggagagaggacactgctattaccagggcctggaactagtacccrtgttcccctttattctgcttttgtctcgctttgagcttggggcagaggaactcttctgctcttccctgtacaacaggtctgtcatgcagaggctggttct

SEQ ID NO: 68644 - DNA, 201 bp, Homo sapiens
ggactgcccctgagacaggtgtatgggtctggagccagcaggcaggggtgagaggtggcaaggcttcccagggggagcaaggctagaggatgacactgcamaatttgaagatcgagaaggagcatcgggtgctgtggcatgtcggggccgtgtggtaccagggtcacctggggctctggcagggaggacaggacgatgtgg

SEQ ID NO: 68645 - DNA, 201 bp, Homo sapiens
aaagtgtttgctggagttcccaggggcattcagccataaacagtaccatcttcctggcctgattactgaaccagctgagaaattagatcaaggcaagagtrgacaaagccaaaatatcagctgtaaaactgagagcggctacatgggaggtagtagcttaggaagagagccaaacagacattctctctccatggcaggcag

SEQ ID NO: 68646 - DNA, 201 bp, Homo sapiens
acactgctattaccagggcctggaactagtacccatgttcccctttattctgcttttgtctcgctttgagcttggggcagaggaactcttctgctcttccytgtacaacaggtctgtcatgcagaggctggttcttataaaagattaaccttgtctccctcctatagcctaagaccacctgtgagtcacctcccattaatc

SEQ ID NO: 68647 - DNA, 201 bp, Homo sapiens
tttgttctctctgagagtgatactcataaagtatttttaaacttaaaataaaatttgtaactccatttcatcttcacaaaaactgcatggccagcaagggmagtgttatacgctcactttactaaggttcagactcagattctacctctaaaatgtgaatctcttttgtgtgactttgatgtcagtttctcaccatctgta

SEQ ID NO: 68648 - DNA, 201 bp, Homo sapiens
tattaccagggcctggaactagtacccatgttcccctttattctgcttttgtctcgctttgagcttggggcagaggaactcttctgctcttccctgtacarcaggtctgtcatgcagaggctggttcttataaaagattaaccttgtctccctcctatagcctaagaccacctgtgagtcacctcccattaatccacctct

SEQ ID NO: 68649 - DNA, 201 bp, Homo sapiens
gttggcttgctgcctccttttccttcttgtcttttctttcaaaactctttgcagaatgctggctggtgtacggggtggtgcacttcatccctccctcgccrtccaacctctccaagtcacagggttgggttcattgtagttgcttgaaaaaagagtattagtcaagtcaaggtttttaggaaaatggctgtgcttgggagg

SEQ ID NO: 68650 - DNA, 201 bp, Homo sapiens
cagctaggaatgaagcccagcatccattagctattcttcctgatgctcttcctcccaccataaccaccaccaacaggccccagtgtgtgttgttcccccartgtgtccatgtgttctcatcattcagcttccacttataagtgagaacatgcggtgtttggtttctgtttctgtgttagtttgccgagaataatggcttcc

SEQ ID NO: 68651 - DNA, 201 bp, Homo sapiens
gctgtgcttgggaggtgcttagacattactgacagcccactcctgagtgtcactgccccagatgctcctgaagcggggccagggatgagagtgaaaggagkgatggggaaaggccgtgagttccattgagggcccacctcataccaacactggtttgcatactttgccccacattatgacagtaacactgggaatgggtca

SEQ ID NO: 68652 - DNA, 201 bp, Homo sapiens
ctcccaccataaccaccaccaacaggccccagtgtgtgttgttcccccagtgtgtccatgtgttctcatcattcagcttccacttataagtgagaacatgyggtgtttggtttctgtttctgtgttagtttgccgagaataatggcttccaactccatccatgtccatgcaaaggacatgatctcattcctttttatggct

SEQ ID NO: 68653 - DNA, 201 bp, Homo sapiens
tgtgcattgatgcacaccctgcttaccctatatctcacacacatgcacacacttgtacacatgcatgcatgcacatgtgcacgcacgcgtgcgcgcgcgcrcacacacacacacacacactctctgcttaccctgtaccaaacactgttctaagcactttacatatatcagtatgtttaatccttaaaacagccccaggag

SEQ ID NO: 68654 - DNA, 201 bp, Homo sapiens
tgcatgtatgtcttcttttgagaagtgtctgtttatgtcctctgcccactttttaatggggttgtttgttttcttcttgtaaatttgcttaagttccttgyagattctggatattagacctttgtcagatggataggttgcaaaaattttctcccattctgcgggtcatctattcactctgatgatagtttcttttgctgt

SEQ ID NO: 68655 - DNA, 201 bp, Homo sapiens
actgcaggaaaaaaaaatggaaactcacataagttctttagaaaaaaagcaaagaacaattattctgaatttgaccaccgttaacattttggtatagtttmtcctaatccttgcatgcatgtgtgtgcttgtgggtgtaaataaaacgagatgtactgtacattttgtgacctgagttttctactcaataattattgtgaa

SEQ ID NO: 68656 - DNA, 201 bp, Homo sapiens
tgaaaaaactgaatcccagaaggagaacattcctatagcaagtaatgacagagctgggtcttggaagcacatctcctgtctgtcaggacagagttatcctrtatcccaaccttagggcagatctgagaactgacgacagcaaggcaagggaatgggttacgaggccaaggacaagtgtggctcctcagcgaaaaatgtcaa

SEQ ID NO: 68657 - DNA, 201 bp, Homo sapiens
ctttcttatttgtgaaaatatgtgtgcatacacacagagacatacacacatgtgcacacacacatgcatgtgcacacacacacacacacacgagctgactsccttaaaccaggtagctgacctccatgggtccacactctgggtccaaactcaactgaaggaaagtgaactgaaggagacatttgtgaatttgattctcca

SEQ ID NO: 68658 - DNA, 201 bp, Homo sapiens
agtctcaggtcaagtgacttgcctaagatcatgcagccacataggaatatggtgctatcctagaaccatggtttccaaatcccacacgtgtgctcttggcrgtatgctctgctgcctctgtgttgatttttccttttgaatatcttcttagagaggaacaggagacttgtaaagttttatgtgggctcacagtttaaagag

SEQ ID NO: 68659 - DNA, 201 bp, Homo sapiens
cttaaggtcaaatcactatttgctgcctgaagaaaaaaaaaagaccttgcttagggacagaagtccttgtcctggtcttaggtcagatgagggggtaaagraactcttccaactgtcaaggaattgggtattttgccaccaaaaagtttcatgatcaaataatgatgatcataatcagtgaaagctggattaaactgaaaa

SEQ ID NO: 68660 - DNA, 201 bp, Homo sapiens
catgatcaaataatgatgatcataatcagtgaaagctggattaaactgaaaatagtacaggacttctccaagcctttcctatgaatttgcccattaaattycctaaaagagagagagaggctatgcgtattgaatatctgttagtacctggaaaatccagttttctgtttttcagtatgggggagaacagaaccctgcttg

SEQ ID NO: 68661 - DNA, 201 bp, Homo sapiens
catgcccagctgaagcccctcgtgccaaggacacagacttgcttctgccactgagctgtgactctgtccaggatgccttcagcctagcaggacagggcagrctcctggacacggagagcactgggcccagagaagaggcaggcatgtgtggggcatggtctctcctcgcctgcaggccacgcaggaaggaggaatccttct

SEQ ID NO: 68662 - DNA, 201 bp, Homo sapiens
gcccagctgaagcccctcgtgccaaggacacagacttgcttctgccactgagctgtgactctgtccaggatgccttcagcctagcaggacagggcaggctsctggacacggagagcactgggcccagagaagaggcaggcatgtgtggggcatggtctctcctcgcctgcaggccacgcaggaaggaggaatccttcttaa

SEQ ID NO: 68663 - DNA, 201 bp, Homo sapiens
ccaaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttct

SEQ ID NO: 68664 - DNA, 201 bp, Homo sapiens
tggttggtaccaagcccaggggcaaatggaacctgagtccagtccaggatttgatttctttctgattgtagtagagatgaggtttaagtacttagaaggarttgagctagaaatattttgggaaaaaatacactgaggagaagggagatcattgaaggggagggcacactccttcctctcaaaggcatgatctggaatttg

SEQ ID NO: 68665 - DNA, 201 bp, Homo sapiens
caaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttctt

SEQ ID NO: 68666 - DNA, 201 bp, Homo sapiens
aaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttcttg

SEQ ID NO: 68667 - DNA, 201 bp, Homo sapiens
ttcctccaattctaagctactctagcaaaaggcaatatattattactgaggagagaagagcaggaggaaaggaaaaggatgggggaaaaatcagtgtcacmggtacaaatggctgccggggcaccaaacattctttaaagaagaatattttgagcatatatgaatctaatcttctaaatgtggacagtgtttgtttttgga

SEQ ID NO: 68668 - DNA, 201 bp, Homo sapiens
ttggagcatggggtgaaagtgttggctttattggatgcagtgctctgggatggggggtctgctctctgcagcggagcctgatcagggacagagtccagcayaggacatgggtgggcctggccggcgtgggctgcagaggggaatggggcctatgcctctctgcggggacgccacagtgctggtcatttgcaatctggcctg

SEQ ID NO: 68669 - DNA, 201 bp, Homo sapiens
ctctgcagcggagcctgatcagggacagagtccagcacaggacatgggtgggcctggccggcgtgggctgcagaggggaatggggcctatgcctctctgcrgggacgccacagtgctggtcatttgcaatctggcctgaaagttgggtctgctggcttgtattctcttcctgctttgcaccaggatcctggctctctgggg

SEQ ID NO: 68670 - DNA, 201 bp, Homo sapiens
ctatggtcagtaattctactgtttagaacacagtgtaactggtaagaattccttcccagacatgagctgtgaccatgaacacatctctcatttccctgcaragtccttgcagcactcatctcttctgttagcaagaagtccaatatcttcctgtctttctctttggattttctaggagcccagggactaaagcatccagaa

SEQ ID NO: 68671 - DNA, 201 bp, Homo sapiens
tgcaatagctgaaatttatagtggtacattccctgataacagacatgactcttagtgctgcataggtattaatgctttaaaccaggggtctccaacccccmggccgtgggccggtagtggaggtgagctgcatgtgaacaagtgaagcttcatctgtatttacagccactccccatcactcacattactgcctgagctcca

SEQ ID NO: 68672 - DNA, 201 bp, Homo sapiens
cacatgagggtgcagagtgatgagatctcgaaaccgaaagtgacctttcaatggcagacacttccactgggcctcagaattgtctcctgtagttaaggggwatgagaatcaggccaaagatggggatgtggcacgttcaggctggtgaggacctgatatgcacaaatcaggcagggaggacctggcctcttggtggcagag

SEQ ID NO: 68673 - DNA, 201 bp, Homo sapiens
cagtgttatctggagagtgcggtacgacgtaatctggagaaggtggcacactgtgatctggagagtttggtatgctgtgaattggagagtgtggtacatcrtgatcttgagggtgtggtacagtgtggtctggagagtgtgacacactgtgatccagaaggtgtggtacggtgtgatcttgaggttgtgatacagtgttat

SEQ ID NO: 68674 - DNA, 201 bp, Homo sapiens
aaccttaggctcaagctgtttgtttcactcatcttgtctatgacaagcctttatcatttgagtgtatgactgggaagtgtcttaggttccccacaggacaygcagatgaatgctttcctgcattcatccaaattaatgctcaaattcattcagcattttttctgctaaaaatgaaggagagaaagaggaatcaagtcatgg

SEQ ID NO: 68675 - DNA, 201 bp, Homo sapiens
caagaggaggaaggtggacggagaaagacagtgatcctatattttttatccttctgtaacttcgtattacctggcagaccacctggggcctcccagatgasttcagttctaatgtgccagagagatgggtctcgtgatttttgctgtgaaggagtcagctgagagatagtagctcatgtctaggtcaaaactctggagagg

SEQ ID NO: 68676 - DNA, 201 bp, Homo sapiens
aacatggttgatctttctggcatggcctgcccccatcctgagtaatctcattagcctaaatttaggtatagtcctaggggtctgccaggaataacaaagayactcctatggagggaaattccaaggatttagatgttcatgcaggaatcggggacaaaggccagtgaaattctttattttacagtcagtctggatgtaaaa

SEQ ID NO: 68677 - DNA, 201 bp, Homo sapiens
tataaataaagtgttgggggaacagttatgaacggagacaacaagaagacttcagcaaaggaaaggcttacacagccttaaatggatgagtaggatttcarcaggtgaacacagggatgaccctgcaagtaagtaggattattctgattgtctgtctggttccatggtgggcttttactgttttgcttccccgacctgcac

SEQ ID NO: 68678 - DNA, 201 bp, Homo sapiens
atgattctgttcccctgaaacataatggacaacttgtctctcagggtgttcccaggtttggagaaggtctaggaagtgcttccccatgtcctacccaactwgccttttttggggtcctatcccatttattctggccccttgattttaataaagaagaagaactaaccaccattctctgttagttaacaaaatttgaaacca

SEQ ID NO: 68679 - DNA, 201 bp, Homo sapiens
tcctgtgttgacaccatgcatgagggaattgtctccaagcttgtttccaccctgtgagctcctctcagagaatctgttcacagaggaacaagccacaggartacaggccctggagcaaaaacagcgagggaggggtagttaaaaaacagcatttcccagcattgcccgtgaagcattttcaaaaacagattcctggccctc

SEQ ID NO: 68680 - DNA, 201 bp, Homo sapiens
tgagggaattgtctccaagcttgtttccaccctgtgagctcctctcagagaatctgttcacagaggaacaagccacaggagtacaggccctggagcaaaamcagcgagggaggggtagttaaaaaacagcatttcccagcattgcccgtgaagcattttcaaaaacagattcctggccctcccccaggttctgagttggca

SEQ ID NO: 68681 - DNA, 201 bp, Homo sapiens
ctattgtttccaaactgatatccactctctgagtcatccatgcaaatgaattctgtgatcagcgtgacccaagtgctggatccatgttgaatgagatttgragttccttgcttttatggagctgatgttttccttaaaaagccagttaggagatgaataaataaacaagatcactttggatagcaataagtgctgtggtag

SEQ ID NO: 68682 - DNA, 201 bp, Homo sapiens
ttatcaaagcattattaggattgtttgccccacactgctctgatttcttgaattcttgactctggtaacctccctccccgagttttgctatctcagtttcrctttgcagtgtgggagatggaaaaacaagctcattagaattttgggtaaagagagtgtaaaatgcatggcaggaggtctgaaggattctgctgtggaaaa

SEQ ID NO: 68683 - DNA, 201 bp, Homo sapiens
cgtgtagggataagggtcaggagaaagaatagagcaaataaaggagatgaaaatgaagtgggagtgggaaggtattttaaatagagtagtcggagaaggtsttcctgatgtaatatttgaggaaaacagggagcaagccacatggctgtgagaagacagatacatgcaaggaaagcaaataacacagaagacatggtggtg

SEQ ID NO: 68684 - DNA, 201 bp, Homo sapiens
agtgggaccaggtggtggaatgagttcacacaaggcagttgtgagattttgggataagaagagcagcccctgggtttgtgctgtagaaaacattgcccatmattaactgggtttccttatcagttggggccacagggtccctggtggataaagcaatgatgatgatgatgctgctgttgctgatgatgattttaatgatga

SEQ ID NO: 68685 - DNA, 201 bp, Homo sapiens
ctgcctgcccagggaatctgctgtagtattgcgatgtcttaacctcatctgttttctatccgatgctaatagtctcggtgtttaatttcctgaaaagtccygcatcagatttaaaggaaaaggaggaagcatgtctcaccacatctcacctctctcgcccaaccattttctgtcctcccactctctaatttttccttcctt

SEQ ID NO: 68686 - DNA, 201 bp, Homo sapiens
gaaagcaaactatagctgctctcccctcaccttccatccacttccttatcatctgcagtgttggttttactcccactattcccttgaaatttcctcacaarggttgcagatgatcttaatggcaaattctaatggacgccttgctgctcttaacttacttgaactctctgtcaagaagagctgtgcctctatgtcccttcc

SEQ ID NO: 68687 - DNA, 201 bp, Homo sapiens
gaacagaggggtttggcagacatttcaggggtaaagtttataggatcggtaccaaattggacatggggcatgaggaagaacagctatcaaggctgcttctrgatttccagctcgttgactgtttggtggagcatttgcaggagcaggaaatgctgaaaaagaatcctgttttggagaagatcgtatgtttggatttgggca

SEQ ID NO: 68688 - DNA, 201 bp, Homo sapiens
gagaattgaaggctgagctgagggaggagctgggtggagagtgaggagaggagtcatgctaaggttttgctatggaagccggcttggcgtgttctaagaamaggaaggaagccagtgtggctgagatggagtatacaaaagattgcatggcaagagataaagttggagaggagtcaaagcccggatcatggtaagcattgg

SEQ ID NO: 68689 - DNA, 201 bp, Homo sapiens
gtggagagtgaggagaggagtcatgctaaggttttgctatggaagccggcttggcgtgttctaagaacaggaaggaagccagtgtggctgagatggagtayacaaaagattgcatggcaagagataaagttggagaggagtcaaagcccggatcatggtaagcattggaggccacagcacagggtttagatgtattcaaag

SEQ ID NO: 68690 - DNA, 201 bp, Homo sapiens
gagtcatgctaaggttttgctatggaagccggcttggcgtgttctaagaacaggaaggaagccagtgtggctgagatggagtatacaaaagattgcatggyaagagataaagttggagaggagtcaaagcccggatcatggtaagcattggaggccacagcacagggtttagatgtattcaaagttcatagtcatttggct

SEQ ID NO: 68691 - DNA, 201 bp, Homo sapiens
ggcacagatatgcagttgcctactggacatctctacttagttgtctcgtgggtttccccacttagacatggcaagaacaactcctcctcctcctcctcctyatcctcatcaaaactgcctcttacgttgtattctctatcgtagccatcggcaccaccaaccacacacatgccctaagaccatgagaatcatcgctgattc

SEQ ID NO: 68692 - DNA, 201 bp, Homo sapiens
acggaatctcgctctttcacccaggacggactgcagtggcgctatctcagctcactgcaacctccgcctcccgggttcatgccattctcctgcctcagcckcccgagtagctgggactacaggcgcccaccaccgtgccctgctaattttttgtatttttagtagaggcggggtttcaccgtgttagccaggatggtcttg

SEQ ID NO: 68693 - DNA, 201 bp, Homo sapiens
tttcacatttgccttaggctgttgcataaataactctccctgcctagaataacctctttgcccctcacactctctccacctttctctttcttcttctaccrtctttcattatttagtcttaaatagtaagagtaaattatttatttagtaaattaagttagtttacacatctcttcctcaaagagaacttcgctgccttag

SEQ ID NO: 68694 - DNA, 201 bp, Homo sapiens
ttaaatagtaagagtaaattatttatttagtaaattaagttagtttacacatctcttcctcaaagagaacttcgctgccttaggccaggttaggacttttrtgttctcataatcactaaacttctccctttataacactcttatattggtcactcttgttttattggtcgttattggtcacttttgtttaaatgtccccat

SEQ ID NO: 68695 - DNA, 201 bp, Homo sapiens
agagaacttcgctgccttaggccaggttaggacttttatgttctcataatcactaaacttctccctttataacactcttatattggtcactcttgttttaytggtcgttattggtcacttttgtttaaatgtccccattgccagtgagattatttcatcaaacacatcacatgtcttattagtcacatttttttttcctgg

SEQ ID NO: 68696 - DNA, 201 bp, Homo sapiens
atgcttactgtgtccagatattgtgctaaggactgtataaacattgtttcacttaattcttatttcaaccctgagaaattgggccattattatcattctasaccaaaaaagtcctgaatgtagttgtcttagtctgctcaggctgctgtaacaaaatgccataggcttaattgacagaaatttattttctcatagttctag

SEQ ID NO: 68697 - DNA, 201 bp, Homo sapiens
ctgagaaattgggccattattatcattctagaccaaaaaagtcctgaatgtagttgtcttagtctgctcaggctgctgtaacaaaatgccataggcttaaytgacagaaatttattttctcatagttctagaggctgaaaggttcaagatcaaagtcgaaaagggttgaatttctgatgagggctcttcttacaggtagct

SEQ ID NO: 68698 - DNA, 201 bp, Homo sapiens
atggcaaattctaatggacgccttgctgctcttaacttacttgaactctctgtcaagaagagctgtgcctctatgtcccttcctgagttttggtcacactrttctcttcttactccttccaatattttggctacttcatggtccatgtattttttagatgacagagcattgcacgacatgagaggctgtggagtacaagga

SEQ ID NO: 68699 - DNA, 201 bp, Homo sapiens
tgaatatcttcttagagaggaacaggagacttgtaaagttttatgtgggctcacagtttaaagagaacctgtttatggggttgtaataaccatgtattcayggacacaactgcttatgtctgtgaaggatcagcaattcatcagacacttagtgagttactttcttctctgattgtcagagtgaaaggtgagtaagatcac

SEQ ID NO: 68700 - DNA, 201 bp, Homo sapiens
cccaataaaaaagtgaggttatgtaatgagtgggagaaaagggatagaagaataggggacttgcgtagagagaggggcaatttggacacaaccgatgggtrtataggagaatgagaaaagtatggccaggcagcaacgggggcacacctgatgttgccagttgtgactgcatagtgacatcaatccatgcagttgtgtaat

SEQ ID NO: 68701 - DNA, 201 bp, Homo sapiens
tcacagtttaaagagaacctgtttatggggttgtaataaccatgtattcatggacacaactgcttatgtctgtgaaggatcagcaattcatcagacacttwgtgagttactttcttctctgattgtcagagtgaaaggtgagtaagatcacttctctcagggagctcacagtcatatgcactgagtcacatgacatagagt

SEQ ID NO: 68702 - DNA, 201 bp, Homo sapiens
gcttgggctgtctgaacacctggccttgagccttctcgattgctacctgagccatatcttcagttcagtaagacaaaactctcacactttctatgatgaartagttgaaagaaaattttacacattgtaacattttcctagatggctttcttatcttttaaagatgtctagggaaggacgcccgttggcttctccttgtaa

SEQ ID NO: 68703 - DNA, 201 bp, Homo sapiens
ggtgctttctctggaataccctcatcccccttttcatcccgggaaactctaatcattctttaatcacagttgaaatgtctcctagtcattgaagtctctcyttaatcctctgggctggaagtcactccctcctctatgtttccatgacactttgtatgtcacatcatgtcataatttgcgttcatctttctcagtttctgc

SEQ ID NO: 68704 - DNA, 201 bp, Homo sapiens
actcacggggaaatgtcaagtagactggtgggttcatgagattggaaaccaatgagctggaagaatatgattcactttgcttttctgtggttcccatcccrtgaactggggcaaatcatataactggcaaatggggtttcttggctattttagggtcattgggaatctatttccagtgctatgaactcctgtaaggcattt

SEQ ID NO: 68705 - DNA, 201 bp, Homo sapiens
ctatgtttccatgacactttgtatgtcacatcatgtcataatttgcgttcatctttctcagtttctgctactacctagggccaagaatttgagctgttctyctatgtatgcctagtgcctggtgctagcatgatgcttggtacatatttgatgttcaatgtatgcctcctgtatagaaacaagagtaatacaactcacaat

SEQ ID NO: 68706 - DNA, 201 bp, Homo sapiens
tttgccagaacatagggtcaatgtatgaacattttgatagaagccagtctgacctattcctggccctcttgttattatctggagggttgaggcagatgatrataatgaagtggccagtgacgatggcaaggtttggcttcctgtcctttgtgggcttcccaaagaatgaggaccacagcctgcttcttttgaagcccaaat

SEQ ID NO: 68707 - DNA, 201 bp, Homo sapiens
tgccagaacatagggtcaatgtatgaacattttgatagaagccagtctgacctattcctggccctcttgttattatctggagggttgaggcagatgatgawaatgaagtggccagtgacgatggcaaggtttggcttcctgtcctttgtgggcttcccaaagaatgaggaccacagcctgcttcttttgaagcccaaatcc

SEQ ID NO: 68708 - DNA, 201 bp, Homo sapiens
aaaacagtgcacagccacttttacaatggctttattcataattgccaaaaactggaaacaattcaaacatccctcagatagtgaaaggataaatgaactgyggtacatccacacagtggaatattattcagcaataaaaacgaacaaactaccaagacatgcaaccacatggacaacatgaatttcaaatgcactatgcta

SEQ ID NO: 68709 - DNA, 201 bp, Homo sapiens
attgccaaaaactggaaacaattcaaacatccctcagatagtgaaaggataaatgaactgtggtacatccacacagtggaatattattcagcaataaaaaygaacaaactaccaagacatgcaaccacatggacaacatgaatttcaaatgcactatgctaagtcagagaagccagactcaacagcctgcatactctatga

SEQ ID NO: 68710 - DNA, 201 bp, Homo sapiens
atgtgagttgcctaaggtcacccagatgactcactagtggaattgaggttagagccactttccagaccattccacgggagacgtgcttcaagacctgtagkaacttgggcttctgtggaaggatggaatgaagtgaggcttcctccctccttcctaactggctagacctcccccgttccagaagggcccatgtcttggact

SEQ ID NO: 68711 - DNA, 201 bp, Homo sapiens
gtgaccttggcatgtctatgatgactttttcatgttccattcctgtttgatgaaatagaagtagaggctcaccttgttatgaatggtggaaggagacccartgtggctcatgtcaagaagagcttactccactcaagaattattttcctatttatacttctatatccaaatacagtaattggcttaagtaacagcttctgc

SEQ ID NO: 68712 - DNA, 201 bp, Homo sapiens
gttctcatacctctgtgtgcctgcactctcttgacctgcttcataggttgggtaattttaaatgcatggcaatttggtgtgatagatctaactatattttrcagatagggcacataaattattttacagataaggaagctgatgatctgggaatttcccaaggtcactcacctaagaagtaccagagccaagagttcagaa

SEQ ID NO: 68713 - DNA, 201 bp, Homo sapiens
ctccctcttggttcttcctgggcatcagccatgccatttcctctccttgtctcttcactgctgtgagtaagggcttcattagagtcgcttcctttgaaccrtccaaggggaattgtttcctgctgcaatcctcagtggtagaggggtcaggccaacatccgaagttaaacatggagatgcctgggtagaacctgcccttcg

SEQ ID NO: 68714 - DNA, 201 bp, Homo sapiens
actagtgactttggcagcttggaagacagtggtgcaatctttgtgtttctcttggcttcttatgttgggagtgtctgaatgcatgagcactgtgtgtgtgytgggagctgtgacttccagaaaaaagagatcaccaatgtaaacatgagaaggggtgatttttcaacatccactagaatgttatatcaaaatgagcatttt

SEQ ID NO: 68715 - DNA, 201 bp, Homo sapiens
tcaaacgtaaagttgagttcccttcctctttcctataagaaaggctagggtttggaaatacgagggtctggaggaggtgacaattggctccctttcccccwaaagaagccagccaaccagaaagtgcttcttaagagcctgatttaagctgagactgagactaagaagtccagtggctcagaagtggtctctgcccccaga

SEQ ID NO: 68716 - DNA, 201 bp, Homo sapiens
ttgttttcacaaccttccattcattgaaatgccactctgctgctcgtccctttctaagatgctaagaggatgtggcctatgggagaaggggagccgtctarggaaattgcccccatgctggaagtgggaacggcagggaagagggccctattttccattgaagaaaagccgggacaaatgcttcttttctctttcccagga

SEQ ID NO: 68717 - DNA, 201 bp, Homo sapiens
caggtttgttttcacaaccttccattcattgaaatgccactctgctgctcgtccctttctaagatgctaagaggatgtggcctatgggagaaggggagccrtctaaggaaattgcccccatgctggaagtgggaacggcagggaagagggccctattttccattgaagaaaagccgggacaaatgcttcttttctctttcc

SEQ ID NO: 68718 - DNA, 201 bp, Homo sapiens
agagaatttgtggcaggaaatttgccctggaaatgtactcagctgaatacttgcacttcttagcatggaaagactcccatccaagaatctcagcatgcttrtctataaacatgaatgaattaatcctcctagcaccactgtgtgctctttgccagctgggttattttaagggaagtgaccaacccagcagcctgtagtgag

SEQ ID NO: 68719 - DNA, 201 bp, Homo sapiens
gaacagacaacctacagaatgggagaaaatatttgtgagtcatatatcagacaaaggacttatatctggaatatagaaataactcttataactcaacaatraaaagatgaacctgattttaaaatgagcaaaagctctgaatagacatttctccaaagaagatatgcaaattgctagtaagcacgtaaaaagatgttcaac

SEQ ID NO: 68720 - DNA, 201 bp, Homo sapiens
atcttctattgggatggatgtttgagaagtctctttccaagacttggggctaatgaattaaaagcataggataccaaagatcaagagcttaggtataagaygagcgcagtggctcatgcctgtcatcccagcactttgggaagcagaggcaggtggatcacctgaggtcaggagtttgagatcagtctggccaacatggtg

SEQ ID NO: 68721 - DNA, 201 bp, Homo sapiens
tcaataagatccatcaaaaaaatcactcaatgtttaattcagtgcttagtatcattgcacctatcactgtgtttgcatatgactcctgctcccttcacctmgtcacttgtagcagagggccgtcagtacctttttgtgcacaggctacctcactcatcatttctaatgggcattcctcctattctgttataggaaattgca

SEQ ID NO: 68722 - DNA, 201 bp, Homo sapiens
tgacgccagtggtcccacttccgtcgccaccaattagctgtgtgggtttcacatgcttgtcaaccttgtctgttcagctatttcaaagcttcctcttttgrgtgattagagcagagaccccaaagttttctagtttatgtatatagacgtgttcataatagcaaagaatacattccacctaaatgctcatcaatgataggc

SEQ ID NO: 68723 - DNA, 201 bp, Homo sapiens
gaccccaaagttttctagtttatgtatatagacgtgttcataatagcaaagaatacattccacctaaatgctcatcaatgataggctgggtaaagaaaacrtagtacactgtggactaccatgcagccgtgaaaaagaatgagttcatgttctttgaaggaacatggatggagatggaggccattatctttagcatactaa

SEQ ID NO: 68724 - DNA, 201 bp, Homo sapiens
acccttgaaccatacttcctgggctcaaatcccagcttttgaccaactagctgggtaaccctgtgtaagttacccacttgcccttatcaagactcctatgygtcttgatttgcttgcctattaaaaaaagataataatataataggattgtcaggagtagtgaatgaattagtatctgtgaatagaagagggtcttagtgc

SEQ ID NO: 68725 - DNA, 201 bp, Homo sapiens
ttgtcaggagtagtgaatgaattagtatctgtgaatagaagagggtcttagtgcttagtgctaatacagtgcttagaagagggcctaacacatacaaaagytgtgtattaagtgtccagtgttattcctcttaatggtcttgaagcctgaggaaggcagagttagggaaatatactctactttgtcagggccatgccactg

SEQ ID NO: 68726 - DNA, 201 bp, Homo sapiens
aatcttttatttatattattatttcacccagatagattcacataggtgtgattaggtatggtcattctatggttcttgattcattttaccaaattgctttytgaaagaataagaacaattcacccaggcatgggcaatatatgagaataccctttcagtgagtataaatcacttaatatcctgaatcctaaagtcatgtga

SEQ ID NO: 68727 - DNA, 201 bp, Homo sapiens
gaatattctagactcatccttagcttagttttacacggtgcttcctctaggaagtcttcccaggtcaagccccagttcctcttgagagaaatcatcacttktttctgtcctagtattgtgtttggtacacacgctgatggcatcttactgaattatggtagtattgcttacacatatgttcttcaacagacccagtcaagg

SEQ ID NO: 68728 - DNA, 201 bp, Homo sapiens
tctacatgtaaagcaaatgacaatttgtgaatgtattttttcctctgttattgatgttggctgaggggccttaggacagttaccttttggggtcagttacwttctgattgttcacagatatctaagagtaaaagtgtcgtacgtctgtcacctcttcaagctttgctctaaatacagtagtacactttgcctgtggtgcct

SEQ ID NO: 68729 - DNA, 201 bp, Homo sapiens
gtttgatgataatagcacctacctcataggactattctgggaatcagttgatgcatgtagagtgcttccacatgtagaccgtcaatgaacattggccaccrttgttattgtccagagttcagtttctctcaaatctagaaagtttttgactcaaaacagtttgaagctcctgaatacggtgatctctggaggttcttcctg

SEQ ID NO: 68730 - DNA, 201 bp, Homo sapiens
tgcttccggttgaccagcagagaggtgtgctcgaagatcgcctgctcttctcattcttttggccttgtctttgggttttagaaaccacctactgaggccargcaaactctgaactggatgcaggaggctcttctcccgcttactgccccaggcttgtctcgagacttcaaacaaggcagggaagggcccagaccagaatcc

SEQ ID NO: 68731 - DNA, 201 bp, Homo sapiens
agccaagaccacttgtcctcccactgcccccagagaagggcagctccccacagagtgtccgaggtccatgcactgacttcttgtactcatctgtttccccyactgcatgatcgacttctccatggcagagaccttctcctgctcattagtagattgcctgtgtcaagcccatggcagggactcaatgaatatttttgaatt

SEQ ID NO: 68732 - DNA, 201 bp, Homo sapiens
cttttgtttactaaccactcactgctctttggtttaggaacattccaggcctgagtatgaaaccaaagttcgagagaaaatgctaaaggagagcaaccagkctgctgtccagaaattggaaacaaacacgacggagtgtggcgatgaggtatgaagctggacttgctgctcacggtcctctttacttgttgagatcctgtt

SEQ ID NO: 68733 - DNA, 201 bp, Homo sapiens
tggaggactgacatttctagatggacagccgctcactttcagccaagaccacttgtcctcccactgcccccagagaagggcagctccccacagagtgtccraggtccatgcactgacttcttgtactcatctgtttcccccactgcatgatcgacttctccatggcagagaccttctcctgctcattagtagattgcctgt

SEQ ID NO: 68734 - DNA, 201 bp, Homo sapiens
aggggatgagggtccctcttgcctcttactctgggcccagggagacatggtccaggctttccacgcaggcttcgggtggtttatcagttctttgagtagakgaagttccctcgtgccctcttttgaggcactaaatgaccgaataaccacttgagggtcaaaaacataaagaatcaaaataattatcgcagcctcttctta

SEQ ID NO: 68735 - DNA, 201 bp, Homo sapiens
ttaggataagaagactctcacatgcaaaacagcgaggaaaaaataaaagaaaaatatgtaatgaagatctacagtgtgtggtataagctataaaagtttcrgaattcagagagggaggagaccccacctggtaggtatgttgcaacagttggagaagtcctcctggaaggggtgggactgacgtcccctcggagaatgggt

SEQ ID NO: 68736 - DNA, 201 bp, Homo sapiens
tgaatgcacactaaattttcacaattaatcagattagcaaccaatcaggtttcacattttaggtatagaatcctggatggatctagaagggttctccagargtcatttgattcaactctttttgcccttgggcagtaataatcagaaatgttggctgggttgggctttccttccttttcaatacttccaggaaggagtgac

SEQ ID NO: 68737 - DNA, 201 bp, Homo sapiens
cgcccggcccagggatcaatttcaaaatgagatttggaggagacaaacattcatactctatcagcctcagtttattttttttctttaaacagaattgatargaacatgactcccaacttcttgattctctctctctacttgtggttagcattttccctagaagtcagaactcccatgtaccagtcagtctccaaatgattc

SEQ ID NO: 68738 - DNA, 201 bp, Homo sapiens
atatgtatttgtctttggaaagatacgaaattactgttaaccacagcaatgccttttaacaaaaaattttcccatcagaaaatgtttctctttggctgatrtaatgaagtcagggtccactccacctggtagaataggtgggaactaggaggcagggagagcccagccaggatggaattgcatctccatggataactccca

SEQ ID NO: 68739 - DNA, 201 bp, Homo sapiens
ataatgtatttaaaaagtgcttattgagcacctactatgtgccagccactgtgctagcagctgtggatgcgaaagtgaataagacagatatgttttcaccktcatgaagcttacagtccatgggaaagactggcattaaacaaggaagtaattatttatatcatcattttattcagtgacacaaatggtgtgggactgtgt

SEQ ID NO: 68740 - DNA, 201 bp, Homo sapiens
tcagatgaaggcactactgtgtcaccattggctcctgggtcctggctccaggtggggagaagcagtttctctttctggggcaacaaataaaatccctccgrgcacaggagtgctcattgctggttggttatgccagtctgtctctatttttagaaagagctacaagagggaggaaaagaatctagagaaataagtacagat

SEQ ID NO: 68741 - DNA, 201 bp, Homo sapiens
cttgagagaaatcatcacttgtttctgtcctagtattgtgtttggtacacacgctgatggcatcttactgaattatggtagtattgcttacacatatgttyttcaacagacccagtcaaggagtgactctgaagagcagtaggtagggaccatggcttattcatcttcacagcctccagagtctagcacatttcctggcat

SEQ ID NO: 68742 - DNA, 201 bp, Homo sapiens
tcatctgtttatctaaaacccacaagcttttgttcctctagtcatccaaaaaataatcgctattataatcctgcctcaggaattcaattatctcccttacrgccttcccccagcttcttaaatgcaaccacagttttgaggcccttgggctattactgtgggtgatgagatgaatttcttctgtcattcattcacacagtc

SEQ ID NO: 68743 - DNA, 201 bp, Homo sapiens
ttagaaagagctacaagagggaggaaaagaatctagagaaataagtacagatggattcctccctgaggcagaagctggggtctgtgggatgaagcacagayacaaagccattgtcctgccacccagcagtggagtcggagatggatggcatgaatctagaataccatgggaatgggtccttgccctgggccagtaaacatt

SEQ ID NO: 68744 - DNA, 201 bp, Homo sapiens
ccaggtccccgggccccaggtctgcagggcggttccaacagagatcctggccagccctgcggtggagagagcacccgcagcagctctgtgagtactgggcrggggtggggtggggggataggccagccctgttgcaggccaccaaggagcctctggtctgggggatcctccagttgggagcacatgtgtgcgtgaaagaga

SEQ ID NO: 68745 - DNA, 201 bp, Homo sapiens
tctagagaaataagtacagatggattcctccctgaggcagaagctggggtctgtgggatgaagcacagacacaaagccattgtcctgccacccagcagtgsagtcggagatggatggcatgaatctagaataccatgggaatgggtccttgccctgggccagtaaacatttgagactcagagccaggagataggatgagaa

SEQ ID NO: 68746 - DNA, 201 bp, Homo sapiens
gggagctggtgtgctagagcagaggtgtatggcgggaccccagggagccagcaggagagagggggtggagactggcggggcagaatgcagggtcccagccsgagagccatgggagccccataagtttgtgctcttgagggtgtcctggccagatggatgtttgtaaggacccctggctgccttgtggggaacagggacagg

SEQ ID NO: 68747 - DNA, 201 bp, Homo sapiens
agaaataatggtgatggtgtttcagaaatggtgattgagaaagcatactttaggtagtgaattgccttttaaaggaattaatagcaaaaatatctcttacytgtcattgttttcaccatttccggtactctctatttcattgtgtagatccaaatttctactgagattatattccttttgcccaaagatctttctttaaca

SEQ ID NO: 68748 - DNA, 201 bp, Homo sapiens
agcagctttttgaagcaagaatggattgctttggattttctgggtccctaaggaccaaaatagtaggtggcccacaactagatgaagagtgtgtagggaarcatggtccaggcagcgggaagaatgcatgtaggatgctgggctggggagctggtgtgctagagcagaggtgtatggcgggaccccagggagccagcagga

SEQ ID NO: 68749 - DNA, 201 bp, Homo sapiens
ctctgatcctaccccttcttcatctgcctctgtagagtgacctaaggtacctgcagtcctgcgagtggtgaggttggctccaatgagaagggacagaggtstcacctgaggccactgatatgaaacagccaagactgtaccgaaaggattaaaaaatgtgtggtcatccctgatgagtaaacccacttgtactaataatgg

SEQ ID NO: 68750 - DNA, 201 bp, Homo sapiens
ctggaagcagtggctttgggaggttggggatggaggtggcccctcatttcagggcccttcatacttcagccaccaggagttaggaatgagacagtaatgaygccaagagggaaactcagaggaaaagcccaactgcccagaagtccagttccctcaggacacctcctcctcctgctgctggtctctcttggaggctctgga

SEQ ID NO: 68751 - DNA, 201 bp, Homo sapiens
gcctgtctggttttgctggaagcagtggctttgggaggttggggatggaggtggcccctcatttcagggcccttcatacttcagccaccaggagttaggartgagacagtaatgatgccaagagggaaactcagaggaaaagcccaactgcccagaagtccagttccctcaggacacctcctcctcctgctgctggtctct

SEQ ID NO: 68752 - DNA, 201 bp, Homo sapiens
taaaattttgtgaattttataaagggtacgtgtatcagaaaaacagttaggaatctgtccatccatttattcacctacccacctgtccatccacccacccrcccatccatttatccatccttctcctggcacctcatttatcctcactacagccagggccatctttctaatgtaatctaattatgttgttctcttgcttaa

SEQ ID NO: 68753 - DNA, 201 bp, Homo sapiens
gagagatgagaataagaatgatatctttaatcttggttacacccaggaggaagagatgggagatgtttatgggtggtggagaatgatgagggacacggagrgagcccattgaatatacccaggatgtcaatggaagagcaaacagagcaaatctgttgcaaaacaggttataattaatgagccaacagaccagttttgacc

SEQ ID NO: 68754 - DNA, 201 bp, Homo sapiens
ccctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtga

SEQ ID NO: 68755 - DNA, 201 bp, Homo sapiens
acctcagtcccagtccattttgggtaggagaaacctattcctactttggagagatgagaataagaatgatatctttaatcttggttacacccaggaggaakagatgggagatgtttatgggtggtggagaatgatgagggacacggagggagcccattgaatatacccaggatgtcaatggaagagcaaacagagcaaatc

SEQ ID NO: 68756 - DNA, 201 bp, Homo sapiens
gaacccttccagattagagcctcttgagaaacaccttggattttccacagcataccctggcaacaacagcaaactcctacataagctcaaagtgatcagcycatagttgaacttcctgctagaaagttaaaaaaaaaaattccaaccccctcgataggaagataatgttttatcattcacaatgtccagtataccataaaa

SEQ ID NO: 68757 - DNA, 201 bp, Homo sapiens
tgattaatcttggcccactaccttagctagatagggtcattgttctagcacatacccagaccaccaagcatgagtttgtgtgtatgcacatgcatgcgtgygcacatatgtgcataagtatatgtaagcactcatgtatgaattttcctgaatcttttccaaagacagaaaatttagaagctcttccaccatgcttccata

SEQ ID NO: 68758 - DNA, 201 bp, Homo sapiens
gagtgactgttcatgtcaaatctccatatttctaagccttgctcaacagagcctttcccaaatttccaccaacctaacagatttaacccacctcacacttmtgcataccacaggtggggagagatactcaaaggcagggatggaggatggatctaactcatctttgatccttactgcagcctgacacacggtaggtgctca

SEQ ID NO: 68759 - DNA, 201 bp, Homo sapiens
atttctccacaaactcaccagcagttgttattattcatctttttattatagccatcctcatggacgtgaagtagtgtgttactgtggttttgcctgaaccyaggagcaagacaagcctgtcactggagaaggaaaagctcctctgcctgcaaatccccaagcatgcttaggcttcctggtcttagaagtgtgtgcctcaat

SEQ ID NO: 68760 - DNA, 201 bp, Homo sapiens
gaaattgctctggctaatgtagagaggaaattcttaaaaaatcagggttttgaagactggttggcttttaatgggcagcaaagggaagaaggggtgcccaygagaaagaaacagcagcagccttgacctgggaaagcgaggcaacaacaagatatcttgaaagccaagttggcttcaggggacagggctcagtatgcagtg

SEQ ID NO: 68761 - DNA, 201 bp, Homo sapiens
ttgattgtcagactattttccaaagtggctgtaccattttacattcccaccagcaatttatgagggttctgatttctccacaaactcaccagcagttgttrttattcatctttttattatagccatcctcatggacgtgaagtagtgtgttactgtggttttgcctgaacctaggagcaagacaagcctgtcactggagaa

SEQ ID NO: 68762 - DNA, 201 bp, Homo sapiens
ataccataaaatgtaccctttaaaggtgtccagttcagtggctgttggtatattcacagagttgttcaaccatcaccgcaatctagtttaaagcatttgcrtcatcctaaagagaaacttcacactcaatggcagttgctcatttttcctccctccccctagcccttggcaaccgcgaatccactttctgtctccatggat

SEQ ID NO: 68763 - DNA, 201 bp, Homo sapiens
tgaaaaccatgaaatttatatcataactaattaataggttaaacctgttatcctaaaagtagtgacttagtcatagggaacagtcaatggctagtagtctrtttggagcagtgacactgagtctctttttccttctctgtgtaagaaagggatacgcggcactccatcaggaagttcttaggaagaattcttaatcgcatt

SEQ ID NO: 68764 - DNA, 201 bp, Homo sapiens
cttgttacaagtcctggggacgtttagcctacagcatctgaaggtaagtaaacaataagtaaacaaccagccggactgggtttaactcagcaacggtccgytgaggacagagcaaatttgactttggcatccctggagtggcctctcagtttcagaagttttttccagtgtcttacccaaaaccgcattcaggaagggttc

SEQ ID NO: 68765 - DNA, 201 bp, Homo sapiens
cctagaaccatggtttccaaatcccacacgtgtgctcttggcagtatgctctgctgcctctgtgttgatttttccttttgaatatcttcttagagaggaayaggagacttgtaaagttttatgtgggctcacagtttaaagagaacctgtttatggggttgtaataaccatgtattcatggacacaactgcttatgtctgt

SEQ ID NO: 68766 - DNA, 201 bp, Homo sapiens
aggcgcccaccaccgtgccctgctaattttttgtatttttagtagaggcggggtttcaccgtgttagccaggatggtcttgatctcctgacctcgtgatcygcccgcctcggcttcccaaagtgctggaattacaggcgtgagccactgcgcccggcctcatcattttcttgattgtactctatgctgcaagcattttgaa

SEQ ID NO: 68767 - DNA, 201 bp, Homo sapiens
tccagccccattgtcaccactgacctcccatattccccaccctttgcctagccctccagcctgagagagctggggtggaggagtaggagagagagacagasagagagagagagagagagagagaaagagaaagagagagatagatagatcagagaatatagtttataactcatcaagagtctataattcaatctagtagaa

SEQ ID NO: 68768 - DNA, 201 bp, Homo sapiens
actcccgggccgcgcggtgagttttccggctggacctggtcctggtctcctacaggtggtaggagggagggagtgaaggaggcggcatccgaactcccacycttcgggattggggacccccaagggagcctgggcagggtggtgcgggaagttgaccccgtttttccagggtagggactctgagggacgtctatgtaattt

SEQ ID NO: 68769 - DNA, 201 bp, Homo sapiens
attttgaactcagtccccagtctttgcctttatatatctttttacataaaaactgtggccccaaatgtgtccatctttcctctggcaaagagaaggccgaraatttggcttcctaacccagagcctggagatacccctgccacccagttggcgccctgaggatctcggctcaagtgtgggcaggcttggagccagtgtcca

SEQ ID NO: 68770 - DNA, 201 bp, Homo sapiens
agcagcctgtagtgagtcatgaaacagcgtgctgacaaccagagagactggactgcaggatggaaagagccaggggccacactgcagcctcccacctccastgcttgagtgtgaggaaggggtcaatgattaacacaataactctgggatctggccaccttttggctcagcacatcctccttcaaggagtttatcacctgc

SEQ ID NO: 68771 - DNA, 201 bp, Homo sapiens
ggaaagagccaggggccacactgcagcctcccacctccagtgcttgagtgtgaggaaggggtcaatgattaacacaataactctgggatctggccaccttytggctcagcacatcctccttcaaggagtttatcacctgccccctagaccatggcttagtcaaattaaatagcttttattttttggagtataaaaataata

SEQ ID NO: 68772 - DNA, 201 bp, Homo sapiens
cctccagtgcttgagtgtgaggaaggggtcaatgattaacacaataactctgggatctggccaccttttggctcagcacatcctccttcaaggagtttatyacctgccccctagaccatggcttagtcaaattaaatagcttttattttttggagtataaaaataatatgtgctaagtgtggaaaacctaagaagggaagt

SEQ ID NO: 68773 - DNA, 201 bp, Homo sapiens
ctcactgcagctcggcacaacattttggttaaatgtaagaaataactacctaagggccgttagtaggtccttatcattaacttgggctgatatacgtgtgyttggagataggatttggacaccatgacctctgaaaagcctgttcagtcaagaagtctgtttctgcagttttgtttgcttcagaagtacatttttaggcta

SEQ ID NO: 68774 - DNA, 201 bp, Homo sapiens
ttggggaactggtcagtaaattaaagtgtcttacgtatatgagacctgcaatttttattctctgggcctctgtatgaattagttttgcattgccatacagraatatctgagaccgggtaatttataaagaaaagagattcatgtggcttatggttctgcaggctgtacaagcatggcaccagcatctgcttggccgctggg

SEQ ID NO: 68775 - DNA, 201 bp, Homo sapiens
gaggtcccagtctctttaaccagctctcacatgaactaatagagtgagaacttgctgatcaccatgagaatggcaccaagacattcctgagggatctgccyctatgacttatacacctcccaccaggctctacctccaacattagggatcaatttttttttttttttttgagacagagtctcgctctgtcgcccaggctgg

SEQ ID NO: 68776 - DNA, 201 bp, Homo sapiens
acggggtttcaccgtgttagccaggatggtctcgatctcctgacctcgtgatcccgcctcggcctcccaaagtgctgggattacaggtgtgagccaccgcrcccggcccagggatcaatttcaaaatgagatttggaggagacaaacattcatactctatcagcctcagtttattttttttctttaaacagaattgataag

SEQ ID NO: 68777 - DNA, 201 bp, Homo sapiens
cactttcattttgtattttttctatttcccaccactgtcctggatccctgggccatctcccagcgcctatccgtttcctcttgcagtttcatctatgaccmcaagaccttctggcctaagatgctctgtccttacagaacagctgatgaggagaaggtaaggagaggagagcaggagtgaggctaatggacacactcattt

SEQ ID NO: 68778 - DNA, 201 bp, Homo sapiens
ggctgtgctgatgaactgacatttaactaagacttagtaggagctggcaaggcagaagagaggacttgagaggacctagcatatgctgcatgtcttaccamgtgctgggccctgtttgaagcagttttaatctttataacatggggcttatgaggtaggtgcctttattatccctatcttgcagataaggaaattgattaa

SEQ ID NO: 68779 - DNA, 201 bp, Homo sapiens
cctatcagatattttccttaaaaatagagctctgagtctgttaacagcgcaagagtcagtccctgcatcaggatctgctgaatgcagagctttgtactggrtgtggtgttgaagcctcaaagaagggggaaaatgggagcttgaagggtactgatgggacacaaggtcctcacaaaagaaaacttcttgggtcggtcacag

SEQ ID NO: 68780 - DNA, 201 bp, Homo sapiens
gagaagaaatatagttgggggatttacaagattgggatttaagcattcttggtcaggaaatgttgagagaagagacttgagaaggggctaaggcagatgartggcttgagaagaaagcaccggggctgagctagacaagggacatgatggtgggggaaattcaggagaggatctcaggtggtttctctggaatttaggcag

SEQ ID NO: 68781 - DNA, 201 bp, Homo sapiens
tataaatattaacaattaccttggtactaaatctatgccttactcaaggcaggtactcattaaatgtttaatactttgaaagcaaactcatttaaacacasatatttcctaagaaaaacataaagaacgggatgctggatgatcacatagaagcgtggcgcagttttagagtatagactttggattaggttgacatgagtt

SEQ ID NO: 68782 - DNA, 201 bp, Homo sapiens
ctaaggttttgctatggaagccggcttggcgtgttctaagaacaggaaggaagccagtgtggctgagatggagtatacaaaagattgcatggcaagagatraagttggagaggagtcaaagcccggatcatggtaagcattggaggccacagcacagggtttagatgtattcaaagttcatagtcatttggcttaagatgt

SEQ ID NO: 68783 - DNA, 201 bp, Homo sapiens
ccgggctccaggctgggggagggggcccgcccctccccgggacccgccagacagaaccccgccttccctgcgattccccgacgtgggcggcagacactgtkccctactccacagacccagggcttcctcccagccctcccgaggctatgtggtctggggtgggctcctctgttttccttacttcctgtgactgccgtccat

SEQ ID NO: 68784 - DNA, 201 bp, Homo sapiens
agctctgctgtcgtccccttttaggtgcacgagatcctgaagcgcacagcctgctcccgagccaacaacacgatgggtaaggaccccagcccgcgggcagrgtgctgacgggcgctgaggcggctcccgccccgtgctttcaacagctcccttggtcggcagcaaagaacaaaacaagcaaatgccccccacggagaggct

SEQ ID NO: 68785 - DNA, 201 bp, Homo sapiens
tgggaccaagtataaggcaggcagtataaggcaggcagtccagatcctgatggattgtgtggaagacatctgtgatggcccaggtacaatgtgagctgtgyccataaccccatgagactgctttttcgaaaaatgtgccaaaaagtcacgcacaaacaccttttgcacaggagtcattcttgcatgttgaacccttgttcc

SEQ ID NO: 68786 - DNA, 201 bp, Homo sapiens
agaggttgagtagtgtccacagaataggtcatcctgtccactccactgctgaggtcacccgctggtgaacactcacatgggatacaaatatcttcacagtytttgaccactcagagaggtccatctacatacctcttccccagatttctttgtcaccaattttccaatcatgcttcttccaagtccctgaccatccaacca

SEQ ID NO: 68787 - DNA, 201 bp, Homo sapiens
gacgttttgggtcccctggaatcaacgtcatctcagagccaatgaccagtagtccccaaaaatctgatcatatccctttccccaatgcacagttaccccawtgcacagttaccctgataaaaggctggaggtctccttggggaaggatgggagaaagattaacagcataaattgtcagtagtatagtggggtccttcctca

SEQ ID NO: 68788 - DNA, 201 bp, Homo sapiens
tggggaatgagtcagctgtgcagggcctgaactaagccatcagaagtacgaatggacaggagaggaagatcaggaggtttaagaagtagaccccatgacamctggggctgatcaaatgtgagtgtgtgggaggaaataacccaagggaatgcctctgtttcaggtgttgcccgctcaaagggtcatggttcagttcacgtg

SEQ ID NO: 68789 - DNA, 201 bp, Homo sapiens
caatgcacagttaccccaatgcacagttaccctgataaaaggctggaggtctccttggggaaggatgggagaaagattaacagcataaattgtcagtagtrtagtggggtccttcctcaaggggacccaacctccccttcaatcaaggggttctgggtctgtaaactggctcaagtccggaaattgattgatgggccatga

SEQ ID NO: 68790 - DNA, 201 bp, Homo sapiens
ctgccacttcaggatccagttattcccattgtatttaaattttatagttgagtgactgtggttcccactgttagatctgacatacagagaagagtgattayagggcccttcaaagatgcaggtgctgccctcacaaatctgttttacaaggcattggtcaagggtatatcttctggacttcccaactaggatgagtaggtc

SEQ ID NO: 68791 - DNA, 201 bp, Homo sapiens
acactcacacacacacgccactcccccccgccaccccccacacagttccttcctttgcagaagagatgagaaaacctctctttctttgtactgtagagcarttcctttggaggacaaagactgttgcaatgagctttttgtctcggcagagtttgctaatacactttaaaatatttattgtgaatgggttggaggaggttg

SEQ ID NO: 68792 - DNA, 201 bp, Homo sapiens
gtacagccactggtgtttcatgcctggcaccccaacccagccccattcttatctccagcacagcatggcttcattcgcgcccctgcttctcagagctcccstttgttctaaccggtcctttccttatcttctccctgcagtgtgctccagggggctgtctcatggagctctgcattcagctcagcatcatcatgttgggga

SEQ ID NO: 68793 - DNA, 201 bp, Homo sapiens
tcttacattaagctgtgcattttgttcactaagtaaagagttgccttgtgcgtgttctggaggccaactccagccacttctgtgcgttaatcatttgttaygatttgagctcattggaaaaaaatcccccagccagtggcacaggggggtggctctgtaccctgtggtacagagtaggaagcctggctggatcagctgagg

SEQ ID NO: 68794 - DNA, 201 bp, Homo sapiens
gagatagcaagtgcaaaggccccggggcaggtatattcctgatgtgttagaggagcagtcaggcgtccagtgtgacaggatgggaaagagcaaaagggagyggggaggggatgagatctgagaggcagctggagacagggtcatgtagggcctcatcagcctccgtcagaactttggattttagtctgagcgagatggaca

SEQ ID NO: 68795 - DNA, 201 bp, Homo sapiens
atatatatatatatatatgtatatatgtgtacacatacatgtatttgcccttgccaggttcctgacatgccccaagaccctggtcagagatttatatataratatatacatatatataaatatatacatatataaatataaatatatttataaatataaatataaatatatttgttttatatatattttataaaacataaa

SEQ ID NO: 68796 - DNA, 201 bp, Homo sapiens
aacaggccaggcagttgcaaagccagcgtacaatgcactttctctgaccctcggccacccttctttccacggcatcccgaatctcccccagaagggcaccrtgtcaacctagaaagagcttgaacccttaagcaaggtcaaagactcttcctcattcccaagccacagggctttgtgaaccttgtcgacctggcagcattt

SEQ ID NO: 68797 - DNA, 201 bp, Homo sapiens
agaataccagaagcttccaatgacaggattgttataaaaacagcattcttttatgcccacccatttaaaagctatgctattataaaaagtaaagaacgagytgctctcaccagggcgcatggtgggtatgtgacctgttgagctgtgaatgactggttggtgatgctgcagaagccacatgggcggggtggatgcagattc

SEQ ID NO: 68798 - DNA, 201 bp, Homo sapiens
tgaatgactggttggtgatgctgcagaagccacatgggcggggtggatgcagattctaatagatattatggcagccttcataatgcaggagtcgtgagggktcccatacatttctccattttgtcaagtagctaaggctttgaaatatttaattgcaattctacaaatgtattatatgctgaagagtccctcttccccacc

SEQ ID NO: 68799 - DNA, 201 bp, Homo sapiens
tcatgctcagataattatttccaactatcactttgtttgcttgtagtctctactgaaatcaaaggaatgactgaatgtgttaagagctaggatgtgctaayggaagtttctctgttttcttctgtgatggcttttggagcctaagaaatcagacgttgctgtttggaggccagggcgcagatcaaatgactactgtaaaaa

SEQ ID NO: 68800 - DNA, 201 bp, Homo sapiens
agggtttctgcaccagtacacagtctcagaggcaaaagaggtctatcatggagaaattagaaggagaaaattgttctgacacacatctaaataaaagattkatgcactttgggaggccgaggcaggtggatcacgaggtcagaagatcgagaccatcctggctaacatggtgaaaccctgtctctattaaaaatacaaaaa

SEQ ID NO: 68801 - DNA, 201 bp, Homo sapiens
tagagttttctgaacagatctctgtgttagtctttctgcagatcctcaattagatggatatgcttgttaaacttaaaacatgttttagacactgagggagracaaagtgacatttccaaaagctggggtgagttaatagcagaggtggaaccagaattagattatttatggattcttttcagactggaaaaaagaggggtg

SEQ ID NO: 68802 - DNA, 201 bp, Homo sapiens
gggagggctgggtcctgacgcagctctcctagaggttccaacaaggcatcaggtgtccttcggaaacattaacaccaacattgcccgtgagcttttagcaraggatgtgctttgtaccaaggcatttcttcatcaaacttttcccataaaatataactctttccttagcacaattgttacacatcctagtgctcttctttc

SEQ ID NO: 68803 - DNA, 201 bp, Homo sapiens
gtaggtctaaagtgactaatccactccaccatcccaatctccctaaccctttggatctcttcctctacgttaaaccaagggagatcaggcattttcagctygccacagtgggccatgttttaatccatatttcagctaaccaagcaaataaactattagaaccccttttaactccccaggctgcaacattaaatgcagagt

SEQ ID NO: 68804 - DNA, 201 bp, Homo sapiens
cgtgcacgtctgtgctcactggagagaagggccatgattcctgaattgtgggtcttgagaaaggagactgactagtggcattgtttaatgaatatgaaatrtctctgctcacaaaaattttgaaatcccttttgatatagactctcttctcttccaacaacacttctgctctttttccttttgcccctagggaaaggaaga

SEQ ID NO: 68805 - DNA, 201 bp, Homo sapiens
agtgtgtgggaggaaataacccaagggaatgcctctgtttcaggtgttgcccgctcaaagggtcatggttcagttcacgtggttgagttaggataaaaaakaaggtttaaggaacaagatgatccattctttttgtgacatttgagcttaggacattccactgaagatgctcactaggcagttggacaaatgagtttggag

SEQ ID NO: 68806 - DNA, 201 bp, Homo sapiens
aaacaaactagcttttgcatggaccttttagagcagctaattcatttatggcaggagaagggaccaaagagcacctacttgtgaatgtcccctaaactgcrgtcactggtaagatgccctgtgataatgggaagaaagcctagattcagccagactcgcattcctaccctgactccacctttactggtcacgagactctgg

SEQ ID NO: 68807 - DNA, 201 bp, Homo sapiens
tctcttccaacaacacttctgctctttttccttttgcccctagggaaaggaagagaagacaaacactccctgggaatggggtggcgggaatatgacctggkgaaattcccaccagccaggaagggagaacaagcctttccaatgagggaagatcctcagaaggagaggaagagaaggggagggttgaggactgattattct

SEQ ID NO: 68808 - DNA, 201 bp, Homo sapiens
gtcacttttagctaggaaaagagtatggggaagtgctggtattaaactcactgcaaccctgtgttccctctaacttcttaagaaagcaaactatagctgckctcccctcaccttccatccacttccttatcatctgcagtgttggttttactcccactattcccttgaaatttcctcacaaaggttgcagatgatcttaat

SEQ ID NO: 68809 - DNA, 201 bp, Homo sapiens
taggtctaaagtgactaatccactccaccatcccaatctccctaaccctttggatctcttcctctacgttaaaccaagggagatcaggcattttcagctcrccacagtgggccatgttttaatccatatttcagctaaccaagcaaataaactattagaaccccttttaactccccaggctgcaacattaaatgcagagtc

SEQ ID NO: 68810 - DNA, 201 bp, Homo sapiens
gggggaatatggtcaggggtgtagctcttgctgcctacagcaatatctttctgtacagaaatctttctaaagtctatcacacaatttcctgcttgcttatrtagaacatgtctacatatattctccacataaaggcgtcttatgtagaacatgtctacatatattctccacataaaggcgtatgacaaattttctggatta

SEQ ID NO: 68811 - DNA, 201 bp, Homo sapiens
aaatctttctaaagtctatcacacaatttcctgcttgcttatatagaacatgtctacatatattctccacataaaggcgtcttatgtagaacatgtctacwtatattctccacataaaggcgtatgacaaattttctggattattcaagatcatcattaagaacataatgattttcatgttctctcaagaattatcaaagc

SEQ ID NO: 68812 - DNA, 201 bp, Homo sapiens
aagtctccggctgcccgtttgagatgcattcccagcattttggagcgatgcttgcctctgtcatctgactgctctggcagggctgctccgtaaacagtccygtgacatcaatctgcaggcatgattagcagcatttgacagggtcgaagggccgccacgtcctggaggacggatgtaggcttgacttcccagctcagctgg

SEQ ID NO: 68813 - DNA, 201 bp, Homo sapiens
gtccttgatgatgggtcggcaggtaagagttccaaataaaaaaagacgtggactctaatccttggaggctctctggatttccatatgtacaactaacacarttcagaggaagatgagctggaggatctggctggggggagctttgcagacatgtgtgaggtttctgattgggaagcggatgccagaaggcacagcaagtcg

SEQ ID NO: 68814 - DNA, 201 bp, Homo sapiens
attatcaaagcattattaggattgtttgccccacactgctctgatttcttgaattcttgactctggtaacctccctccccgagttttgctatctcagtttygctttgcagtgtgggagatggaaaaacaagctcattagaattttgggtaaagagagtgtaaaatgcatggcaggaggtctgaaggattctgctgtggaaa

SEQ ID NO: 68815 - DNA, 201 bp, Homo sapiens
accttaatccactatgacctcatctaaacaaattctatctgcaaaacctcttccataaataaggtcacattatgaggttctgcatggacatgaatttttcrgggtaagggcgctactcaacccacttcaataaccatttgctctttactttaaagtgggaattgatgaaagaatgtttatttactgtcttttttaaaaatt

SEQ ID NO: 68816 - DNA, 201 bp, Homo sapiens
agagtgtaaaatgcatggcaggaggtctgaaggattctgctgtggaaaagggacatcgcattagaaagtaggttttgtgagatctattttagctgctcatktatttttttcttgtttctgggttttctgttgtgagagctgagataaccagataagaggcctctgataaatgaggtgttactgtcaccaaagtaataagga

SEQ ID NO: 68817 - DNA, 201 bp, Homo sapiens
agaccacaattatagagcttggttttgactttttttccagggccttaaagttgatatatttttacatttcctggattggagggtagggagcatggctttgrgtttagcttttgctctgctgattatctcttggctctgtgaaaaaccttggcagtgctgtggggaattggtgcggtggggaatggaggcttgaagagtcag

SEQ ID NO: 68818 - DNA, 201 bp, Homo sapiens
ctcaaatttcttggcttaaaacaatcaaaatccagaagtccaaaatgaaagtgccagcagggtgggttcctcctggaggctctgagggagaatcgtcacayggccgtctcctcgcttcctatggctactggcagtccttcactccaatctctgcctccatctttacattgccttcttctctctgtgtgtctctgtgtatcc

SEQ ID NO: 68819 - DNA, 201 bp, Homo sapiens
aaggtgggcatatgtatagagaaaccatttacaaagggattggcagggagttggggaatgccagggacggcgttgtaacctggaattaacaatagtagagytcttatcatccctagacctgcagaaagatagagaggtcactgcaacgtggaattgggtagaggaggtgaccttgagcaggtgactatttaggcagaaggc

SEQ ID NO: 68820 - DNA, 201 bp, Homo sapiens
acatttcccagactctgtgattcaaaggagccacatgatctgtacatatgagccaacgaggcccagggaggggactggctttcctgaaagttcacagagakcaggtaccaggggtgtggccaggacttggggttgcgtgatgtccgcaggcctcagagaggttgagaggagacaattgtagtgaaagggaagatggagaat

SEQ ID NO: 68821 - DNA, 201 bp, Homo sapiens
ccagccaggaagggagaacaagcctttccaatgagggaagatcctcagaaggagaggaagagaaggggagggttgaggactgattattcttgcccttgggktgaaaccatgcggctgtgagaatgggtttggaagcaaggggaggtaggaacaaagatattttggggtgaatcctagggcacagtgtttgcaagagaacac

SEQ ID NO: 68822 - DNA, 201 bp, Homo sapiens
tctctaaatccttcctggaattcattataatgtggaggttgaaagctggaatctcattagacttgttggatttgaatctcgtctctgcatcttaccagctrtgcaaccttgggttagtgaatgtttttgtacatcagtttcctcatctgtaatttaaggataatagcatactaccttgtagggctgtgagaactaaaaagt

SEQ ID NO: 68823 - DNA, 201 bp, Homo sapiens
aaagtacaaactttgattactgtttcaaaactttcttgttttttaatactacaaatatctctctacgcatagctttaacagtatcctacaaatcttgataygctgttttgttattttcgctgaattgaaaatatttgctgattttctttgtgatttcttctttgatccataggttatttagaaggatgttgtttaatttcc

SEQ ID NO: 68824 - DNA, 201 bp, Homo sapiens
tgttttttaatactacaaatatctctctacgcatagctttaacagtatcctacaaatcttgatatgctgttttgttattttcgctgaattgaaaatatttkctgattttctttgtgatttcttctttgatccataggttatttagaaggatgttgtttaatttccaaatatttagggattgtttccagactctttctggta

SEQ ID NO: 68825 - DNA, 201 bp, Homo sapiens
ctcatacatttgtagttgagacagatcaggtaacaggagacaaattaagaagagaaaagcaaggcatgattgataagaaaatttgcttatttctatagtayataccattttaatataataaccaaaattatgactaatagcattatgcgaagacatatcatatttttaggaatttcatacaatttctggaacacatgttaa

SEQ ID NO: 68826 - DNA, 201 bp, Homo sapiens
tcttttcatattgaaaagactcagttttcttaattaaagacctaataaaagacaatatgaagcacaataaattattttggtaagacacaagtttttgtttracttaaaaggcgaagaaaaaattttcgctatctcttatcaatactccaagaaagtcttgacagtttaaaggagaagatcaaattctagttttgtttcagt

SEQ ID NO: 68827 - DNA, 201 bp, Homo sapiens
tgaaaagactcagttttcttaattaaagacctaataaaagacaatatgaagcacaataaattattttggtaagacacaagtttttgtttaacttaaaaggygaagaaaaaattttcgctatctcttatcaatactccaagaaagtcttgacagtttaaaggagaagatcaaattctagttttgtttcagtatacttttgat

SEQ ID NO: 68828 - DNA, 201 bp, Homo sapiens
agtttcatcctgatccccccaccccaggtccatgcaaaaatggtcttccaagaaactagtccctggtgccaaaaaggttggggaccactgctttaaacaamcatcttatgagctagatacttttattattttgtagcaggggaaactgaggcagaggaaagttaaatagcttgcccaagatcacataattggtaatggttg

SEQ ID NO: 68829 - DNA, 201 bp, Homo sapiens
attatgtttttgcacatgggataagttaaggttacctgcttagatggccaatttttttttacccatatctgtggagaatacattaaaaattgccatttgcycttgctaagtaatcttatgggggatgtggactaaatttggggtataggactttttatagcagttgatatttaaaataaagagcctttttccccctttctt

SEQ ID NO: 68830 - DNA, 201 bp, Homo sapiens
taacttgtttatttagacttttccttttatcttatcatgtcagaagttcaccaagaaactgaagggcttctgaaattggctttgtttcttgggcttgagtwcagtcccttcttatttacctgcctgcggcttcatctgctgattattgatgatttgaagaaaaaattgtttatgtggaatcagcttcacgtggctccttag

SEQ ID NO: 68831 - DNA, 201 bp, Homo sapiens
catccagagcagttggtgaggatggttggaagaagtttgtactcctatagcaattctttgcatgtgattatgggcgacggtggtcaggtgtggttgcatgyaattggcatcagaatcacctggtgtgcttgctaaaaccctggctgtccaggtcccatgccacatttgctgaatcagaatctgcaggggcaaggtccgaag

SEQ ID NO: 68832 - DNA, 201 bp, Homo sapiens
gtaggttttctctaagaaggagttttggatgagtatttgcttattagagatctagggtaacttttaaagctttttttctctttaagtgtaggacagtctayggaattttttttttttttttttttgctgtgggggtccaaaatttgggacgtcctggagctgatgaagttttactacagagccccacggaagtaagaggag

SEQ ID NO: 68833 - DNA, 201 bp, Homo sapiens
gtgcttcacacaggtcttgtatcgagagagagagcttacttagcacgtgcttatgactataccgttccctaagattatttttcctcttctgatctgtatcygagctataataacttgtttatttagacttttccttttatcttatcatgtcagaagttcaccaagaaactgaagggcttctgaaattggctttgtttcttg

SEQ ID NO: 68834 - DNA, 201 bp, Homo sapiens
accctggctgtccaggtcccatgccacatttgctgaatcagaatctgcaggggcaaggtccgaagatctgcatatttaataatctacccagtgattcttasgaactctagagtgaacaaaagaaaaagataaaaataaagatagggtgcactgttgtagtcttcatgacctacttacacttgggaatatgaagtgtattgc

SEQ ID NO: 68835 - DNA, 201 bp, Homo sapiens
gtctcttctatgaagtcttctttgaccccttaggtttcctcttccccacttgtattgcaccctgcaaatattgtaataatttgttttcatgtctgtttccstcctagatattgagcttcttgacaatgagaatagtgtcttttgtcctggtaaccctagtgcttcacacaggtcttgtatcgagagagagagcttacttag

SEQ ID NO: 68836 - DNA, 201 bp, Homo sapiens
cacccacttacaggggagaacccaaagtagaactttggatgtgacttcctttagcattctggaaacccttagtcctggattttccagcctttgcaggtggrtgtcttccctagtggatagttagtaagtgacccactgaaaactgtggagagagtcactcctgcattttaagacttgccttcctcacaagaaaggcacttt

SEQ ID NO: 68837 - DNA, 201 bp, Homo sapiens
gttctggtggacaccaggtcatgtcaattccatttcccgtatctgtttctaccttaccttccccattgccacaatctaattccagcactcactatctcccsttgtgtgattgaacttctttctagatttgcccctccaaaccatcttcatgctgtatcagagtgatctttccaaatgcaaatctgattaagccatttcctc

SEQ ID NO: 68838 - DNA, 201 bp, Homo sapiens
cccttatgagttttcgaaacagtactggtttattctgtctgcccgtctggcttttgtcataatcttccaggtgagttgctgggatagggaatagcccattygaatccgggctgcaggagtaaggacactgcactcattgcttgcacctacctccaggttccggtggtactctgtgacataagaaagcttcatgtgtggcag

SEQ ID NO: 68839 - DNA, 201 bp, Homo sapiens
tcttggccctgcccctgtggatgtgggacagtgttgctaggcctggttgtgtcaggctgcacagatgtgtggtccatgctgggcagggaggaaacatgagycttttcctttggaggtttttagttctaagcactaggcatgaagtacctggtgatttgaaggagacatgggcacgttgacttcgaggatcagtaaggggct

SEQ ID NO: 68840 - DNA, 201 bp, Homo sapiens
tgaagagaggacatggtgaacctgtaagggagaaagtggattcactaagagctgcattagaaggctctagactctgcaagtttaaagggattgttacgtgyctgtgctttactcacaccatgctggtccatatggggcaggactccagagtgtgcctcccttcaccctgagtgctggtcccttctgggaccctgcaagctg

SEQ ID NO: 68841 - DNA, 201 bp, Homo sapiens
cgtgttctggtggacaccaggtcatgtcaattccatttcccgtatctgtttctaccttaccttccccattgccacaatctaattccagcactcactatctmccgttgtgtgattgaacttctttctagatttgcccctccaaaccatcttcatgctgtatcagagtgatctttccaaatgcaaatctgattaagccatttc

SEQ ID NO: 68842 - DNA, 201 bp, Homo sapiens
tctactgtttagaacacagtgtaactggtaagaattccttcccagacatgagctgtgaccatgaacacatctctcatttccctgcaaagtccttgcagcaytcatctcttctgttagcaagaagtccaatatcttcctgtctttctctttggattttctaggagcccagggactaaagcatccagaagagaaggaagggct

SEQ ID NO: 68843 - DNA, 201 bp, Homo sapiens
gttgggtctctctgtctctccctgggtcgagagctgagaggaaagaatatagatgcaatcctgaagaagaaagctttgccattatggccagatggatggcrcatgatggaaccaattagcccattttttgctgaaaagaaagaaaaaaatcagaatttcaattttcaaagcagggactcttttttaaaaacgtttgattat

SEQ ID NO: 68844 - DNA, 201 bp, Homo sapiens
tccaggagcccatgattctttcctgaatctcctctgcctctatgggcttcctcttattctctttcatgtgttctttcttccttatctgtcattgaagtatyagtgttctcagagttctgtcttcagatgtttttctctcctttttcctttcctttgctcttcttacacacacttttctgggcaatttcatacatttatgtg

SEQ ID NO: 68845 - DNA, 201 bp, Homo sapiens
agtgctctctgacgcaggtcaggcctctggggaacacaaaacaatgagcaaaccttgtcctggaagtgaagcaagctgcccacttccagctgcaccgtgcwcaggaagctttatttaagatgggggatagggcgcatggctttaatgtcccaataatttgaggcatttctgaggatctggcagctgggaccaggagttcag

SEQ ID NO: 68846 - DNA, 201 bp, Homo sapiens
atccacctatccatctcttcatccatctgtcctttcatccattcacccatcatttatcaaatatctactaaattctaggaacactcctaatctgctccttrttatttaatttattttggtatttctattaattgagaagatccattcaatccttgcttgacttgatttttctattgcatttgaaacagttgactccttcct

SEQ ID NO: 68847 - DNA, 201 bp, Homo sapiens
cagcctttctgtttgaaggtaccattaaagtccatgcctctcaaaattctcttcctcaagtagagaagatagagcagcatagaaacttctcaagaggaagraagtctcattctggaaaataactccaaactgtttctcatttgcagcatgaagaccacaaacccagtgttttttatatccacctccttctagtgtacctgg

SEQ ID NO: 68848 - DNA, 201 bp, Homo sapiens
gtccagctgagaattagcagatgagctaagtcggtgaaaacaactgctggacttttccacagagttttgggactgtcttaagggtatatacagctgccacrgcaactgtggggtgtgactgtatggattgggttgggtaggttctggggtgcggtctagctggggccttacccgcctgtgatgcttcaacctctatccatg

SEQ ID NO: 68849 - DNA, 201 bp, Homo sapiens
ccttgacttacagtggggttatggtggataaacctgtcataagtcagaaatattaaaagtagaaaatgcatttaatggcctgataaacctgttgtaaagtsgaaaaattgtaagtcgaaccatcattaagtcagggaccttctgcagtactaatggaggttgctgatagctttaggctggcctctctattttgcagacaag

SEQ ID NO: 68850 - DNA, 201 bp, Homo sapiens
tgggactgtcttaagggtatatacagctgccacagcaactgtggggtgtgactgtatggattgggttgggtaggttctggggtgcggtctagctggggccytacccgcctgtgatgcttcaacctctatccatgcctacagcactttgtagctttagcttttaactacaaactcccacaaactcccctcccggcttgggac

SEQ ID NO: 68851 - DNA, 201 bp, Homo sapiens
tgagcacaatctgatggaggctggactggagcttgagaaggacttggaggtgagtcaggcgggtggccagggacttggagatggaatggcaccacagaacygggctcctagtgagcagtgccacctgacagagagcctaggctttattctggcaggtggacttttttttctgctggagaaaccagattttgtttctttctt

SEQ ID NO: 68852 - DNA, 201 bp, Homo sapiens
gaaaaattgtaagtcgaaccatcattaagtcagggaccttctgcagtactaatggaggttgctgatagctttaggctggcctctctattttgcagacaagraggctcagagagggatgacgacttgcttgccccaggccttcccacctcattaggagcaacccatcaaagactcattgtaccactatcacaaaataaaagg

SEQ ID NO: 68853 - DNA, 201 bp, Homo sapiens
ttgcatgactatgtcgaccaatgtttactgcatgagaagttaaggctgagaaattgtgaaagtgcaagaatacacaaacacacatgccattagccataggkgatgatgtcagcatgtgccacaacaccccactatgtacttgtgaaggaagagtgagaaagcagttagaaaccgttagtgctgttagaaaaatagttttcc

SEQ ID NO: 68854 - DNA, 201 bp, Homo sapiens
cagaaagagcagagcaagtgagctggaccccaggaggggagaaggggagccagagtgttttctgtgtctgctaggaaaaccaagcagtgggaggaagaaaraatgttttccattttagccacaaattacactgcgttctgtcctgggctttaggcatgcctgcagacttaggtgctgtgccacatgactgccttatgccct

SEQ ID NO: 68855 - DNA, 201 bp, Homo sapiens
atgtgccacaacaccccactatgtacttgtgaaggaagagtgagaaagcagttagaaaccgttagtgctgttagaaaaatagttttcctccagggaccccygaaagcctcatgaggactcccagggctccccagaccacattttgagaaccactgccctgttgcttcctgcccacctcagggatattatggtccaggcggc

SEQ ID NO: 68856 - DNA, 201 bp, Homo sapiens
cgggaggaatttgagcacaatctgatggaggctggactggagcttgagaaggacttggaggtgagtcaggcgggtggccagggacttggagatggaatggyaccacagaaccgggctcctagtgagcagtgccacctgacagagagcctaggctttattctggcaggtggacttttttttctgctggagaaaccagatttt

SEQ ID NO: 68857 - DNA, 201 bp, Homo sapiens
gatcttatggggcatttgctaacatacataactatagaagaaatgacagaagcggcagcgctagctgtaaatggtgagcacagatcattatccagatgatyatttggtgaagcagtgcaggatcacccaggtcttttatctcggggggccatacccacccaggcaggaccggaaggagaaaaccacaaagctttccaccag

SEQ ID NO: 68858 - DNA, 201 bp, Homo sapiens
aagagacttggtgcatggatcttcctacgtgaccttggcatgtctatgatgactttttcatgttccattcctgtttgatgaaatagaagtagaggctcacsttgttatgaatggtggaaggagacccagtgtggctcatgtcaagaagagcttactccactcaagaattattttcctatttatacttctatatccaaatac

SEQ ID NO: 68859 - DNA, 201 bp, Homo sapiens
agtagtattatgcctacatgcctcttccattccatcaggtcagtagtgaggagagttgagtcaatctagttgagtgaggttttgttgttgcaagagtcacmttcagtgcactgcactacaaacttcagattccttcagtgatagtacgctattaccttatgctttgtgtgagccctggagtgctgaattggtcctcattgt

SEQ ID NO: 68860 - DNA, 201 bp, Homo sapiens
tacagggactatcgcatcctcccattctctgtcaaatgtaaaactattcacatatcccagttttccctggacggacttggcatttaaaaaaaattcagttstcctggttaccttacaacttcagctctctgatgagctcaagcaaagttataatttcacagattatccagatttctcttgttgttaggctgggaactatat

SEQ ID NO: 68861 - DNA, 201 bp, Homo sapiens
tttaagaagaagaaagatctcaaataattaattttacatctcaagtaactacaaaagaagaaaaaactaagcccaaaattagcaggagggaagaaataatmtagattaggggataaataaatataagacaggatatgaaaacagaaaaacaaaaaattgatgaagctaagagtttgttgacgaatccttagttagactaat

SEQ ID NO: 68862 - DNA, 201 bp, Homo sapiens
agcacaagcaacaaaagcaaaaatagacaaatgggaatatatcaaactaaaatgcttctacacagcaaaggaaacaatcaacagagtgaaagtcaatatgsagaatgggagaaaatatttgcaaaccatatatctggtaagggattaatatccaacatgtataaggaacttctacaattcagtggcaaaacaaagaaacac

SEQ ID NO: 68863 - DNA, 201 bp, Homo sapiens
tctaccaaagtttctttgtgtccctctattttttaattctttaaatttcattttgtatttgtggtaagaacatttaacatgagatctagcctcttacattytgaagtgcatgatactattttgttgactgtagccactatgttgtacagcagaactctagaacttactcatctaacataacctaaactttatgcccattca

SEQ ID NO: 68864 - DNA, 201 bp, Homo sapiens
gaaggcagtcactggaggaaaagatgtcagcccaggtttttgcagaaggccatgcaagatatttatccatcagtaaacatgaactgattgtgtaccaactsagatattgtacctttgtgaattcttcccctgctgcctcctcagggatgcccctgtttcctatgcatgcctttatgatgggcctcactgacttgcgctgta

SEQ ID NO: 68865 - DNA, 201 bp, Homo sapiens
ctgtagtcttcaaaactttgaaaaccacaacttttcagtggcagtgagatgggtgaatacctgcagggtgaggcaggagtgaatcatgacattaaaatacyttgactgaccctggaccactcattgctgacaataatccccagtttgatttttgccaatcatctcaaactgtctcggcaatgatttccccagatgacacaa

SEQ ID NO: 68866 - DNA, 201 bp, Homo sapiens
taaactggcttaaaaataaagaaataaaaaccacccataagcccatcatccaaagaaaccattactaatattttattggatttcttctagtcgtttttcartaagtgtgtgtatgttggtttgcatacccaagtatacatgcccaaatatatgatctgtgtgttttgtttaaataagctagttccaaaaaggtgtgttttc

SEQ ID NO: 68867 - DNA, 201 bp, Homo sapiens
taacatgcaggtacatattaacgaaagatcattattttaaaaaaaattttttttgaagaaaatctctcagaattccttgtacaatgctttggttaagtaargaaaacagaatgactgtaatgaaatctctccttgactggagataatgttacgaacataccatgatacaatgcaatggtattcttcaagacagtttacgag

SEQ ID NO: 68868 - DNA, 201 bp, Homo sapiens
ctcagaaagagttggaagggacctttgagagtctttaattagcgtctcattttacagatggaggtccatggaagttcagtaacatactcaaattcacaaaygcatttttaaattgtcctctgccctctagatgggtgctaaacactgggcatggaaagtgaaatctctcgtgactaggaggggctcagaaacggatgcctg

SEQ ID NO: 68869 - DNA, 201 bp, Homo sapiens
ggaaggacccctgcatttggagctgaaggacatggagaaggcttgggagccgcagtgtagggtggcctctctggggcctgtagggattatttgccatggtrtcccaacctgcccatcctgccagcacctggatgttctccttcactcttccttaccatctgtggctgttcccatgttctccccaaggcccaggctcattgc

SEQ ID NO: 68870 - DNA, 201 bp, Homo sapiens
aggcccaggctcattgcaggcagattctaggcaagccaagaggcgctagagaatgtcagtctccctctcctgaagctcacctggtgctattgtgcagcttscgtgactcagccccaggtaggggctggaagtctctttctttcccctcctggagggtcgttaagaagaggcttcctccgtcttgagaacaaggaattcctg

SEQ ID NO: 68871 - DNA, 201 bp, Homo sapiens
ttcctccgtcttgagaacaaggaattcctgccttcctagaagccaggacaaccggaagagggagcagcgtgggggtagatgggtccctcctggcttccagyagctgcctagttccccatttgccaaagctgcctagtgtcctggaaattcccagagaagtggctgtcaccatctgctcagggctgcccggctcccactggc

SEQ ID NO: 68872 - DNA, 201 bp, Homo sapiens
tggtgctctgtagctccagctgtctgtttcaggggctgcctgatcacggcctcctctgtatgcttctagcttttctgtatcaagcccagatagttctcttrgctcctcctcatctatatccacaagctgtggatacatctttgtgcttagaagagaccatggtgagagagggactttctggaagtctctttcagcagatct

SEQ ID NO: 68873 - DNA, 201 bp, Homo sapiens
taaatacttgttaaatgagtgaatcatgaacattagggctcattttgctggactaggcaagacgtgggaataaagaagacggggttctgctaatcaggtgyaggactgcctcagagtgtgataaagttcatctctgttgtttgaggaaggagaagccagtttccatagcctcccgattctgaacatctccccctggatgtc

SEQ ID NO: 68874 - DNA, 201 bp, Homo sapiens
cagtgttgatccaggaaagggtggatttagcaaatcacatgaggaatatgctggttggcctgacagaatgtggactttttatggcttttccaaattagaarggaggagagactaggccctgggtttcctcccttctgtgttgtcacagaatgatgtcctgttttctggcaccttggacatttccccagcttctgttgaaca

SEQ ID NO: 68875 - DNA, 201 bp, Homo sapiens
tgcagagtccagcctgtggttcccttcctgagccatcacaggccccacaccatgacagttttgctccatgactacttactaccatgcatggcaccctccgkgtgcctcgcggagaagttgccctcatatggtctgtgctggaagagtgacggagcaggggaatctggcacaggcggaacgtgataattcatgcacaggcct

SEQ ID NO: 68876 - DNA, 201 bp, Homo sapiens
ctaccatgcatggcaccctccgtgtgcctcgcggagaagttgccctcatatggtctgtgctggaagagtgacggagcaggggaatctggcacaggcggaaygtgataattcatgcacaggcctggccaaggtctttcccacccgtttctttgggttttcagctcctcatttttagcgccaagcttctgttcctcctctgga

SEQ ID NO: 68877 - DNA, 201 bp, Homo sapiens
attgcaagcccttctaattccacgtagcacagaagacagcattcagtccccctcagaaatgcgttccagtaaatcccttggaaaattttgaactcagtccycagtctttgcctttatatatctttttacataaaaactgtggccccaaatgtgtccatctttcctctggcaaagagaaggccgaaaatttggcttcctaac

SEQ ID NO: 68878 - DNA, 201 bp, Homo sapiens
cccactggactctgggctttttgccctccctggaggctgctctgtggcctctgaagcacaggttggccctgggtgaccattttttgggacccagatcagtycatcacctcacagggcgaacactcagacttgccgctgtcttcctcactcttacctatataaaacttgtcttgaagcagttctcctcttataattctcaag

SEQ ID NO: 68879 - DNA, 201 bp, Homo sapiens
aggttattggtgaagcggtgacgccaccctcctggtgtgaggataacaataactgtagcaaacagtcgctgagcgcttacccgcagtatttccaagtgcgrtaactgagacaccgaggcatacgaaagctaagaaaatttgctggagttcatggtgttcacaaagcctcaaagcaagagcataacactgtgcctggcacat

SEQ ID NO: 68880 - DNA, 201 bp, Homo sapiens
ggaaacactgccacaggctaggtgataaggacattgccacaggtgatgccagtcagaattggccatttttatttcaatgcctagctttcaggtgtttaagwaaaggccttttgcatttcttttaacaacactctaaaagcgctttacatggtaatttaaataaaagcattttcaaagagggaacattgtaattattctggc

SEQ ID NO: 68881 - DNA, 201 bp, Homo sapiens
gtggctcacgcctgtaattccagcacactggtagggcgaggcaggtggatcacctgaggtcaagagttcgagaccagcctggccaacatggtgaaaccccrtctctactaaaaatacaaaaaattagccaggcatggtggcagccgcctgtaatcccagctactcaggaggctgaggcaggagaattgcttgaacctgggt

SEQ ID NO: 68882 - DNA, 201 bp, Homo sapiens
ggtgggggagaaagggtattgaggtaagtgctaatggatatggctttcttttgtgtgataaaaatgttctaaaattgtagtgattcttatgagactctgtraatataactaaaaaccattggctaggcaaaatggctcattcctgtaatctcagcactatgggaggcccaagcgggaggatcgcttgagcccaggagtttg

SEQ ID NO: 68883 - DNA, 201 bp, Homo sapiens
tggatcacctgaggtcaagagttcgagaccagcctggccaacatggtgaaaccccgtctctactaaaaatacaaaaaattagccaggcatggtggcagccrcctgtaatcccagctactcaggaggctgaggcaggagaattgcttgaacctgggtcagggaagttgcagtgagccaagatcatgccactgcactccagcc

SEQ ID NO: 68884 - DNA, 201 bp, Homo sapiens
gcttaccctcagggacacattctctttctcagggatgttccttgctgagaaaaagaattcagcgatatttctgtcatttgcttttgaaagaagagaaatayggctctgttctgcccggctcaccggcagtcagagtttaaggttatctctcttgttccttgaaccaattgctgttatcctgttcttttttcaaggtgccca

SEQ ID NO: 68885 - DNA, 201 bp, Homo sapiens
cacattctctttctcagggatgttccttgctgagaaaaagaattcagcgatatttctgtcatttgcttttgaaagaagagaaatatggctctgttctgccyggctcaccggcagtcagagtttaaggttatctctcttgttccttgaaccaattgctgttatcctgttcttttttcaaggtgcccagatttcatattgttc

SEQ ID NO: 68886 - DNA, 201 bp, Homo sapiens
tcgcagcacattaggggggctagcatgggaggattgcctgagcccaggacttcaagactagcctgagcaatgtagtgagaccccatctctacaaaaaaaawttttttaattttctgggtgtggtggcacattcctgtagtaccagctactcaggaggctgaggttgggggattacttgagcccaggagggcaaggctttaa

SEQ ID NO: 68887 - DNA, 201 bp, Homo sapiens; identical to SEQ ID NO: 46696

SEQ ID NO: 68888 - DNA, 201 bp, Homo sapiens
aaataatattatgaagtatttgccattatcatttctgtttcataagtgaggaacataggtgaaatagcttacagtgtcacagctagtaagtggcagagctrggattcaaattttagcagttattgccacctatttgaaaaaaagatattggcttgtattgatagtgtgattttgtttataagtttcacctgggccgggcct

SEQ ID NO: 68889 - DNA, 201 bp, Homo sapiens
agctcactgtagcctcaaacttgggggctcacatgatcctcctgccttggccccctaacagtagctaggactacaggtatgtgccaccatgtctggctaattttttttttttttgtaggggcaggtttctccacctcagactcctaaagtactggtattacaggcatgaatcaccatgccagccaggaattttaaatagtt

SEQ ID NO: 68890 - DNA, 201 bp, Homo sapiens
aaatatgaattgttttgacaatcacaaaaagcaagtcaccagcaatgagcaaaataaggaaagaactcattaatattcattgaatttttttattttttttwtttttattttttttttttgaggcagagtctcgcgctgtcgcccaggctggatggagtgcagggcgcgatctcggctcactgcaagctccgcctcctgcgt

SEQ ID NO: 68891 - DNA, 201 bp, Homo sapiens
attgttttgacaatcacaaaaagcaagtcaccagcaatgagcaaaataaggaaagaactcattaatattcattgaatttttttattttttttatttttatwttttttttttgaggcagagtctcgcgctgtcgcccaggctggatggagtgcagggcgcgatctcggctcactgcaagctccgcctcctgcgttcacgcca

SEQ ID NO: 68892 - DNA, 201 bp, Homo sapiens
gcagggcgcgatctcggctcactgcaagctccgcctcctgcgttcacgccattctcccgcctcagcctcacgcgtagctgggactacaagtgctcgccacyatgcccagctaattttttgtatttttagtagagacagggttttaccgtgtattgcatgttttttatgtgctagatgctttacatataattacttcatgta

SEQ ID NO: 68893 - DNA, 201 bp, Homo sapiens
agaaggacaccagtcatattggattgtggtccaccctaatgacttcattgtaattacacctgcaaagaccctgtttccaaataatgtcacatccacaggtrctgagaattagggcttcgtatcttttgcctgcatttatagtcccagttacttgggaggctgaggcaggagtatcatttgagatcaggaattcaagaccag

SEQ ID NO: 68894 - DNA, 201 bp, Homo sapiens
gtagatatgaatggatctaataggaaaataaaggtacagaaaatttgggtgatttgctgcaataagttgcagttgaaacaagatcatgaatttgacatgtrtatacttattccagtctctatttcagttaaaaaaatgccagtatcttatgatgataaaaaccattgcacagatttgacatctgtttctatttcacaggta

SEQ ID NO: 68895 - DNA, 201 bp, Homo sapiens
cagaatgtaagtgccatgcattcataattctgaaaaataacgtattctgtaatagtgaaagggttgtatgattcgtgccttttacactttaaaaaaatgawataggtaagttttttaggtgttaaaaaacacagtttgtattacagtggaacatgtaaaaaggatgttttaaattgttcccaagtaggcctgctttcaaga

SEQ ID NO: 68896 - DNA, 201 bp, Homo sapiens
gtattttctctctaagctgacatggtctcagaattctgtacgcattaatctgtgcatctattctcagtcatttgcaattggcatttaatatgaaatctatytgacatccctgtgttaacactgatgttactgttcagtcatttctttgattattcattcattacaatatatagtgagtaccagttaatgccaaccattgtt

SEQ ID NO: 68897 - DNA, 201 bp, Homo sapiens
tatgaaatctatttgacatccctgtgttaacactgatgttactgttcagtcatttctttgattattcattcattacaatatatagtgagtaccagttaatrccaaccattgttctaggtgctagctgctgaggttagagcagtgcctgaatcagacaaaaagccctatcgtcatgggtcctacattctagtgggaggaaaa

SEQ ID NO: 68898 - DNA, 201 bp, Homo sapiens
ttgtaaatataaaatagatttcttagtaaatgtgaacatgtaataatacttaatgaatagtgttcattcagatgtgttttatgtaaatttatggcacagtktatcttgccatgagttaagtttttcatttttaaatgtagcgcctttcaaaatccttttttttttcaagtatggaaaaaaacatataatatgaacatgtat

SEQ ID NO: 68899 - DNA, 201 bp, Homo sapiens
aactcctgaactggtcctgtgatgtgactgcagccgccaggcgcgtgcgcagtgtacactgcgtgcgcatacgcgagcccgttgcgcctgcgcgcggtgcsgccgtcgcccctcttttcgcggcgttctccacctgcgcgggcctgaatggccttcaggagcacagtcggcctgaggagttgatggttactcaccgccgtg

SEQ ID NO: 68900 - DNA, 201 bp, Homo sapiens
caggtgattttgatgcacaatgagaattgggacccaatgacgtagacttactcttttcttcctacgtaggaatttatttaggcaatatctcaaatgagaayctagtttgggcttgcatatctccaatatggagaattaacttatgtcactaagtaaaacatcctattcaaggttggggtagttttagttttaagaaagctg

SEQ ID NO: 68901 - DNA, 201 bp, Homo sapiens
gcgcctgcgcgcggtgccgccgtcgcccctcttttcgcggcgttctccacctgcgcgggcctgaatggccttcaggagcacagtcggcctgaggagttgayggttactcaccgccgtgagcccaagtaactcgccctccttcggctagaaaccctccgcctgggcccgcgcgacaggagcgcggtctctgaggggagcggc

SEQ ID NO: 68902 - DNA, 201 bp, Homo sapiens
ggcggcttcttccgtgggacaatatgttcaagagaatggccgaatttgggcctgactccggcgggagagtaaaggtcagtgcccggaccgcccctcttccrgggtggctctcccgccccggttcctccctgcgcggcgcggggagggcccactgggtttcctttcgcgccttttctcctcgggtttgaaccgtggtttcag

SEQ ID NO: 68903 - DNA, 201 bp, Homo sapiens
catctttatcccatctttgacctcttttccaagaaaactgctttttaacagttacctgttctcaattcctctagaaattactcactcctgtgcatctcatrtatttaaatccctaatactggatttctcagcttcagatagtatctttcagtgcctaatgattgattataggtgatcctttttcgtcctctttccaagttt

SEQ ID NO: 68904 - DNA, 201 bp, Homo sapiens
gacaatatgttcaagagaatggccgaatttgggcctgactccggcgggagagtaaaggtcagtgcccggaccgcccctcttccagggtggctctcccgccycggttcctccctgcgcggcgcggggagggcccactgggtttcctttcgcgccttttctcctcgggtttgaaccgtggtttcaggttggagagcgagtcag

SEQ ID NO: 68905 - DNA, 201 bp, Homo sapiens
ctttccaagtttctttttttcattttgccaaaggaattttttcagaaaggatgcctgagaaataaactttcagagatattgcccatctgaaatgtccttaktttttcttcatagttcattgttggggagaaaaattctaggcactaaaggtagatatgctttcttgtctatgaatggagagagaagagaaagtcaagaggc

SEQ ID NO: 68906 - DNA, 201 bp, Homo sapiens
gtttgaaccgtggtttcaggttggagagcgagtcagagccattgagcgaaaaaccggcgttcattgggccccaacttcctcgcgtcactgccaactcccayccccgccaaaaaacaaacagataaatggtggcttggggaaacccggacgtggctgccaaggaaacgggcgactccgagggctgggaaagctcagcttggt

SEQ ID NO: 68907 - DNA, 201 bp, Homo sapiens
ctaaagagtattcatgttaggtagatatgaatggatctaataggaaaataaaggtacagaaaatttgggtgatttgctgcaataagttgcagttgaaacargatcatgaatttgacatgtatatacttattccagtctctatttcagttaaaaaaatgccagtatcttatgatgataaaaaccattgcacagatttgacat

SEQ ID NO: 68908 - DNA, 201 bp, Homo sapiens
tttcagattaatgctcaagtgttgactacctgaatgccacattgataatcggtcatgttgtattttctctctaagctgacatggtctcagaattctgtackcattaatctgtgcatctattctcagtcatttgcaattggcatttaatatgaaatctatttgacatccctgtgttaacactgatgttactgttcagtcatt

SEQ ID NO: 68909 - DNA, 201 bp, Homo sapiens
agggctgggaaagctcagcttggtgcacattcgctgccaatctaggttattggtgaagcggtgacgccaccctcctggtgtgaggataacaataactgtarcaaacagtcgctgagcgcttacccgcagtatttccaagtgcggtaactgagacaccgaggcatacgaaagctaagaaaatttgctggagttcatggtgtt

SEQ ID NO: 68910 - DNA, 201 bp, Homo sapiens
tagcgcttcattttatatcttatttatgagtctttatttttatagccactggctttttcatcttttgatctcttcttatcagattgttgcttgataatgtaaaaaaaaaatccctccaggcttttgctttgatccttcagcaactttgttaggttgtgataccctcattttagagatcaggataccaaggctcagaggtca

SEQ ID NO: 68911 - DNA, 201 bp, Homo sapiens
ccatgaggtcaggagaagaatgtgtattctgtagccatttgatgaaatgttctgtaaatacctattaggtccatttggcctattttgcagattaagtccartggtatttttttgttgattttctgtctggatgatctgttcagtgctgaaagttggatgttggcgatgccaggtattgttgtattggggtctatctctctt

SEQ ID NO: 68912 - DNA, 201 bp, Homo sapiens
cctcccaggttcaagcaattctcctgcttcagcctcccaagtagctgggattacagatgcacaccaccaagcccagctaatttttgtatttttagtagagrtggggtttcaccatcttggccaggctggtcttgaacctctgacctcaggtgatccacccaccttggtgaaattgtaggttttaatttctagttacagtta

SEQ ID NO: 68913 - DNA, 201 bp, Homo sapiens
ctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgcca

SEQ ID NO: 68914 - DNA, 201 bp, Homo sapiens
tcttggcacctttgtcaaaaatgagttccctgtaagtgtgtggatttgtttctgggttctctagtctgttccgttggtttatgtgtctctttttctgcaartaccatgctgttgtggttactatagctctgtagtataatttgaagtcaggtgattcctccagttttgttctttttgcggaggataacttaggctattctg

SEQ ID NO: 68915 - DNA, 201 bp, Homo sapiens
tgttctttttgcggaggataacttaggctattctggatcttttgtggttccacataaaattttaggttttgttttttttttttctatttctgtgaagaatrtcatttgtattttgatagggattgcagtgaatctgtagattgctttgggaagtatgggcattttaacaatattgattttccagttcatgaacatggaata

SEQ ID NO: 68916 - DNA, 201 bp, Homo sapiens
ttgcccaaaattacccagtagagcctgcattttaaacccaaaatctgtccacttaactaataagttgtaaaaagcctgatagtctgtctcctaaccagtaygctcaactgactttataaaagtagtaattctttggatttgttttctcgaaattgagcttcattgggaaattaaaaacagaaacttttctttttttgtata

SEQ ID NO: 68917 - DNA, 201 bp, Homo sapiens
tatgattacctcataacattagtgcatttttttcttacctgtttcctgcctctgtaccccagcatctaacaaagcgcatatcattcagtgtgttttttaarttgatgtggggagagagggtataggggaatacaaatttctgcatagtaaaaagcactgggaacaaagtctaaagactgacaggccatagaaaaatgtact

SEQ ID NO: 68918 - DNA, 201 bp, Homo sapiens
tgcagtagggaaacagacacaatgctaatgggattataaattggtagatccttttgagttgcttgatgttcttccagaattacaagtacatatatattctrtaacagttccatttccaggaatttatcctacaaatatactaaaatgattatttacagcatacacattattgcattgtttgtaaaagaaaaaaatggagat

SEQ ID NO: 68919 - DNA, 201 bp, Homo sapiens
gaaggacaccagtcatattggattgtggtccaccctaatgacttcattgtaattacacctgcaaagaccctgtttccaaataatgtcacatccacaggtgmtgagaattagggcttcgtatcttttgcctgcatttatagtcccagttacttgggaggctgaggcaggagtatcatttgagatcaggaattcaagaccagc

SEQ ID NO: 68920 - DNA, 201 bp, Homo sapiens
tttctgtttccatagttgggtttttttcccaccaaaccatctggcttccaattagtgaccatcttttattagtgaaagtaagtataagtgtactttaatartgagcagcagttaccaaaaatgtccacaagatggaaatgttagacacaagcagatatttttctttgtaaaacatcatgctacatatccaagtggcatatt

SEQ ID NO: 68921 - DNA, 201 bp, Homo sapiens
gagcagcagttaccaaaaatgtccacaagatggaaatgttagacacaagcagatatttttctttgtaaaacatcatgctacatatccaagtggcatatttwaatagatgtgtcctgttttgcagtaacatttctttagtactttgttatagatagatagtttcagatatcacttaatgtttctcttttctcataacaatag

SEQ ID NO: 68922 - DNA, 201 bp, Homo sapiens
tagtttcagatatcacttaatgtttctcttttctcataacaatagttgatagggctttttctgtaccaggcagtattctgggtactttacataaattaatwcattaagtcttctcaacaggctgggtgtggtggctcacacctgtaatcccagctgcttgggaagctgaggtgggataatcacttgaacccgggagtgaga

SEQ ID NO: 68923 - DNA, 201 bp, Homo sapiens
tggtcctgtgatgtgactgcagccgccaggcgcgtgcgcagtgtacactgcgtgcgcatacgcgagcccgttgcgcctgcgcgcggtgccgccgtcgcccytcttttcgcggcgttctccacctgcgcgggcctgaatggccttcaggagcacagtcggcctgaggagttgatggttactcaccgccgtgagcccaagtaa

SEQ ID NO: 68924 - DNA, 201 bp, Homo sapiens
ttgtcgtcaggaaatgccatatttattaccctgtcatatatcttaaacatgtgagaaaaatactttagtaaaagtatttgttttctttagttgcagagctygaagtgaaaaccagagaaaaattagaagctgctaagaaaaaaacaagctttgagattgcagagcttaaggagagattaaaagcaagtcgtgaaactataa

SEQ ID NO: 68925 - DNA, 201 bp, Homo sapiens
ggacgaggagtgggagatgagatcagagaagttaataggggactaggtcatatagggacttgtgggtaactatgagggcttcagattattaaactgagatwtgaagtcatttgtgagttttgagcaaaggaatgacatcagatttaacttctttaaaatgtttaattttgtgggtatattgtaggtatatatatttactgg

SEQ ID NO: 68926 - DNA, 201 bp, Homo sapiens
cgttggtttatgtgtctctttttctgcaagtaccatgctgttgtggttactatagctctgtagtataatttgaagtcaggtgattcctccagttttgttcyttttgcggaggataacttaggctattctggatcttttgtggttccacataaaattttaggttttgttttttttttttctatttctgtgaagaatgtcatt

SEQ ID NO: 68927 - DNA, 201 bp, Homo sapiens
ggatgacacaagcacccctttagccaccaccactgggactgccttaggtcagacttgaagccagcacattactgggtcttgcccaaggcccactgtaaccrctgcctggctgccacctatgtttgtgtgaggccctaaggctctataatcagcaggtgatgaagtcagccagtatcaggggaaattcagccagatatcggg

SEQ ID NO: 68928 - DNA, 201 bp, Homo sapiens
tttccctaagtgccggccagtctgagaaataaagggacagagtacgaaagagagaaattttaaagctgggtgtccaggggagacatcacatgtcggcaggktccatgatgccccacaagccacaaaaccagcaagtttttattagtgattttcaaaaggggagggagtgtatgaatagggtctgggtcacagagatcacat

SEQ ID NO: 68929 - DNA, 201 bp, Homo sapiens
tcagcctcctgagtagctgggacccacaggcacatgccaccactatgcccagctataattttttttttttttttttttttttttttttttggtggagatgrggttttgccatgttgcccaggctagtctcgaactcctgggctcaagcagtcctccctccttggcctcccaaagtgctgggatcataggtgtgagctgctg

SEQ ID NO: 68930 - DNA, 201 bp, Homo sapiens
aacattttttgtgttttcatgtgatgaagtttttagatctcctaccatctgtgttgcccttcaggaaaacacactcatgttatattttgtttggcaataattttttttttcttttgagacagagttacactctgctgcccaggctggagtacagtggcataaacacaactcactgcagcctccacctcctggcctcaaaca

SEQ ID NO: 68931 - DNA, 201 bp, Homo sapiens
gggtgcatatatgtttacaattgttatatcctcttgctgaattgactcctttattattatataatgaccctgtctctttttatagtttttgttgtgcaatmtgtttgtctgatgtcagtattgctactcctgctcttttttgattttgcatgcaatatctttttttttcatttgcatgcaatatctttttccatcccttta

SEQ ID NO: 68932 - DNA, 201 bp, Homo sapiens
tattaggtccatttggcctattttgcagattaagtccaatggtatttttttgttgattttctgtctggatgatctgttcagtgctgaaagttggatgttgrcgatgccaggtattgttgtattggggtctatctctcttaaactctaataatatttgctttatgtatctgactgctccactgttgggtgcatatatgttta

SEQ ID NO: 68933 - DNA, 201 bp, Homo sapiens
ttaaactgatgacagcttaacactgattgcataaacaagcaagcaaaaagaaagcaataaacactttatattttaacttcatctccccacttttaactttktgttgtttctatttatatcttattgctatctatgtcttgaaaaattgtagttattatttttgatcggttcatcttttcatatttctacctaagacttgtg

SEQ ID NO: 68934 - DNA, 201 bp, Homo sapiens
catatttctacctaagacttgtgtagtttacaaactgcaattacaatgtaataatattctttgtttttctgtttacttgccagtgagttttgtatcttcaratgatttcacattacttattaacatgcttttctttcagattgaagaactcttcagcatttcttgtagggcagctctggtgttgatgaaatctctcagctt

SEQ ID NO: 68935 - DNA, 201 bp, Homo sapiens
cctgtagggtcaaaactcagtaatggctctcacattccacatatgtggctggggtttaactccagtttcaaggctttcacattcatcaccattttatcttgttagaatcacatcagtcttttagcaccaaacatttacattttaattatcagattatattttttaaactgtgtatgtatttttaaaggagctgaatatcac

SEQ ID NO: 68936 - DNA, 201 bp, Homo sapiens
ccatgttgcccaggctgatctcaaactcctgggctcaagcattcctctcgccttgccctcccaaggtgctgggattacaggcatgagccaccatgaccggycaagaaattattaaatattatatctgctatttgtaagatattgtttaagggattgagaaggatacaaaaatgagacactgaccttaatgagaatagttta

SEQ ID NO: 68937 - DNA, 201 bp, Homo sapiens
gaggcatacgaaagctaagaaaatttgctggagttcatggtgttcacaaagcctcaaagcaagagcataacactgtgcctggcacatggggaacattcagyaaatgtcaacttcttttgtttttgatgaaattaccatagaccctagcgtaatgtttgacattgtaatatttatttccctcacacagcccctggcacgtta

SEQ ID NO: 68938 - DNA, 201 bp, Homo sapiens
tctctggttttcctaggcagagggccctgctgccttcccgcagtgtttgtgtccctgggtacttgagattagggagtatgctgccttcaagcatctgtttracaaagcacatcttgcgccgcccttaatccatttaacccttacacatgtttcagagagcacggggttgggggtaaggttatggattaacagcatcccaag

SEQ ID NO: 68939 - DNA, 201 bp, Homo sapiens
gcccgttctcaatgagctgttaggtacacctcccagacggggtggcggccgggcagaggggctcctcacttcccagacagggtggccgggcaggggcgccmcccacctcccagacagggcggcggccgggcgggggctgccccccacctcccggacggggcagctggccgggcgggggctgccccccacctcccggagggg

SEQ ID NO: 68940 - DNA, 201 bp, Homo sapiens
gggtggcggccgggcagaggggctcctcacttcccagacagggtggccgggcaggggcgccccccacctcccagacagggcggcggccgggcgggggctgccccccacctcccggacggggcagctggccgggcgggggctgccccccacctcccggagggggcggctgccgggcggagacgctcctcacttccctgacgg

SEQ ID NO: 68941 - DNA, 201 bp, Homo sapiens
ccagacagggtggccgggcaggggcgccccccacctcccagacagggcggcggccgggcgggggctgccccccacctcccggacggggcagctggccgggygggggctgccccccacctcccggagggggcggctgccgggcggagacgctcctcacttccctgacggggtggctgctgggcggaggggctcctcacttcc

SEQ ID NO: 68942 - DNA, 201 bp, Homo sapiens
atcttttttcctctactaactttgggtttggtttgctcttgcttttctcattttttacaatacatcgttagatattttatttgaagtttttcctctatttkgctacagacatttaaagctacacatttccctctgagtactgcttttgctgtgttgtttccattatctgtttcaataaatttttcagtttccatctgtcct

SEQ ID NO: 68943 - DNA, 201 bp, Homo sapiens
acggggtggctgctgggcggaggggctcctcacttcccagacggggaggctgccgggcgtaggggctcctcacttctcagacggggcggccggtcagagaygctcctcacctcccagacggggtggcggcggggcagagacactcctcagtttccagatggggtcgcggccgggcagaggcgctcttcacatctcagatgg

SEQ ID NO: 68944 - DNA, 201 bp, Homo sapiens
aggataacttaggctattctggatcttttgtggttccacataaaattttaggttttgttttttttttttctatttctgtgaagaatgtcatttgtattttsatagggattgcagtgaatctgtagattgctttgggaagtatgggcattttaacaatattgattttccagttcatgaacatggaatatctttccttttctg

SEQ ID NO: 68945 - DNA, 201 bp, Homo sapiens
gtttccagatggggtcgcggccgggcagaggcgctcttcacatctcagatggggcggcggggcagaggcgctccccacatcccagaggatgggcggccggrcagagacgctcctcacttcctagacgggatgacggccgggaagaggcgctcctcacttcccagactgggcggctgggcagaggggctcctcacatcccag

SEQ ID NO: 68946 - DNA, 201 bp, Homo sapiens
catcccagaggatgggcggccgggcagagacgctcctcacttcctagacgggatgacggccgggaagaggcgctcctcacttcccagactgggcggctggkcagaggggctcctcacatcccagacgatgggcggccaggcagagacgctcctcacttcctagacggggtggcggccgggcagaggctgtaatctcggcac

SEQ ID NO: 68947 - DNA, 201 bp, Homo sapiens
aagaggcgctcctcacttcccagactgggcggctgggcagaggggctcctcacatcccagacgatgggcggccaggcagagacgctcctcacttcctagayggggtggcggccgggcagaggctgtaatctcggcactttgggaggccaaggcaggcggctgggagatggaggttgtagcgagcagagatcacgccactgc

SEQ ID NO: 68948 - DNA, 201 bp, Homo sapiens
acaggtgtgtaccaccacacctggctaattttttttatatttttagtagagacagggtttcaccatgttggccaagctggtctcgaactcctgacctcagktaatccacccaccttggcctcccaaagtgctaggattataggcatgagccaccacacccagcctagttgttttaatttttagctcccacaaataagtgag

SEQ ID NO: 68949 - DNA, 201 bp, Homo sapiens
gctgggcagaggggctcctcacatcccagacgatgggcggccaggcagagacgctcctcacttcctagacggggtggcggccgggcagaggctgtaatctyggcactttgggaggccaaggcaggcggctgggagatggaggttgtagcgagcagagatcacgccactgcactccagcctgggcaacattgagcactgagt

SEQ ID NO: 68950 - DNA, 201 bp, Homo sapiens
ccttcccattcttccctcccctttttccaggcagatgattctttccccgtgtccaccactaccacaggcccacaaggagttctgtcagggtaccacaaatrtttacttaaggcccaagggctcttcagtcagcttgtgttgaatactgccaggcctgggactttcccttcagggcagtgggctcctcttggcctaggtagg

SEQ ID NO: 68951 - DNA, 201 bp, Homo sapiens
ttcccttcagggcagtgggctcctcttggcctaggtaggtccagagatgccatccaagggccaaggcgtggaattggggagttggtaccaaagcttaagasaaagtcccctttactctttcctgtgtgtggaggctgtcccagtaattcagatttggtagaatggtggcttggaccagagtgatagcaatgggagaagaca

SEQ ID NO: 68952 - DNA, 201 bp, Homo sapiens
tacacaggtgggaggtcttggaggaacaggtttttgcaattcagagtacagctttggcggccaggtgtgatggctcatgcctataatcgcagcacattagrggggctagcatgggaggattgcctgagcccaggacttcaagactagcctgagcaatgtagtgagaccccatctctacaaaaaaaatttttttaattttct

SEQ ID NO: 68953 - DNA, 201 bp, Homo sapiens
tgtaagacatgtaagttgagatgttgagaaggatgttgcaccatggcattcaaagagaggagaagtgtaggctggagacataaatttgaaagttaatacarttataaattatgagaccaaatggtatcatcaaaggagtaagtgaagatagaaaagaggtccaaagactgagagacctgggcactccaaaatttaaagatt

SEQ ID NO: 68954 - DNA, 201 bp, Homo sapiens
tgtaagaatttcttaattgtaaaagtcagttgtgcacatggttttaagagaagatttttgaaataagtgtaagtcttctgtgttagttttctggtaccatraactgggtggattaaaacaacagaaatttattcccacagatctgaaggctagaagtctgaaatcaaggtgttggccatgttttttccaaagcctttaggg

SEQ ID NO: 68955 - DNA, 201 bp, Homo sapiens
aaccgtggtttcaggttggagagcgagtcagagccattgagcgaaaaaccggcgttcattgggccccaacttcctcgcgtcactgccaactcccatccccrccaaaaaacaaacagataaatggtggcttggggaaacccggacgtggctgccaaggaaacgggcgactccgagggctgggaaagctcagcttggtgcaca

SEQ ID NO: 68956 - DNA, 201 bp, Homo sapiens
gtactgttgttttaatggaaaaaaatcaaaattgatttagaatattatctatagaggtgtattaaaacaagatttgccaaaaaaaaagttaatttgggacrtgtatttctatacattacaaatcataaaagaattcaacacaggcttcctttttgtttttttaaaaaaagcaaaataggccaggtgcggtggctcacgcct

SEQ ID NO: 68957 - DNA, 201 bp, Homo sapiens
cgggaggccaaggctggcagatcactcgcggtcaggagctggagaccagcccagccaacacggcgaaaccccgtctccaccaaaaaatacaaaaactggtsaggcgtggtggtgcgcgcctgcaatcccaggcactcggcaggctgaggcaggagaatcaggcagggaggttgcagtgagccgagatggcggcagtacagt

SEQ ID NO: 68958 - DNA, 201 bp, Homo sapiens
aatggaaaaaaatcaaaattgatttagaatattatctatagaggtgtattaaaacaagatttgccaaaaaaaaagttaatttgggacgtgtatttctatayattacaaatcataaaagaattcaacacaggcttcctttttgtttttttaaaaaaagcaaaataggccaggtgcggtggctcacgcctgtaattccagcac

SEQ ID NO: 68959 - DNA, 201 bp, Homo sapiens
ctcgcggtcaggagctggagaccagcccagccaacacggcgaaaccccgtctccaccaaaaaatacaaaaactggtgaggcgtggtggtgcgcgcctgcartcccaggcactcggcaggctgaggcaggagaatcaggcagggaggttgcagtgagccgagatggcggcagtacagtccagcctgggctcggcatcagagg

SEQ ID NO: 68960 - DNA, 201 bp, Homo sapiens
gaggcaggagaattgcttgaacctgggaggcggaggttgcaatgagccgagattgtgtcactgcactccagcctaggcaacagagtgagactctctctcaraataaataaataaataaataatgataatatcatctacaaacaaggctaatttgacttctgctgaattttatcagatcctttttcagcatcaattgaaatg

SEQ ID NO: 68961 - DNA, 201 bp, Homo sapiens
aagctgtacttcgttacgcttccctgaactttttactgattactattcctaccttagttttcttttctcatgagtaagcatccatagctcatttaaacatwttttgtgttttcatgtgatgaagtttttagatctcctaccatctgtgttgcccttcaggaaaacacactcatgttatattttgtttggcaataatttttt

SEQ ID NO: 68962 - DNA, 201 bp, Homo sapiens
attccatgtgtttgtatagtttccagaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccat

SEQ ID NO: 68963 - DNA, 201 bp, Homo sapiens
aagaaatcattgtaccctgtaacctcattatgagacagctcttgaagtcactcttagaaaggtatataacctattgcactgctatagtgattaatctgttkaatagattcccatatagatttacataggcctgaattttattctctaaaaaatattatagggttttttagtattattaaactattgtactttttcaatagt

SEQ ID NO: 68964 - DNA, 201 bp, Homo sapiens
caggttctcgctctgtcactcaggctgggttgcagtgtcatgatcgtagctcactgtagcctcaaacttgggggctcacatgatcctcctgccttggcccyctaacagtagctaggactacaggtatgtgccaccatgtctggctaattttttttttttttgtaggggcaggtttctccacctcagactcctaaagtactg

SEQ ID NO: 68965 - DNA, 201 bp, Homo sapiens
gtcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttc

SEQ ID NO: 68966 - DNA, 201 bp, Homo sapiens
tagggttttttagtattattaaactattgtactttttcaatagttagctcttacagaaaatgtccagtgaaggtttatttaaaatatctaagaaagacaasttggttggaagacaacttgtgatttacttctgctacccagtaacctattatacagatcaagccactataaaaagaatggttgtttctaaaagcaaaatgt

SEQ ID NO: 68967 - DNA, 201 bp, Homo sapiens
tcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttct

SEQ ID NO: 68968 - DNA, 201 bp, Homo sapiens
ataaatttagctctttaggaaagctatctgggaatattaatcaaaggtctaaaaaatatgtatagttttaataatctgagggcatatgatagtcaatattkagtaataataaaatgccagacttattcagtgcttactatttgtattcttctgagtctgtacatgtataaactcacttaattctataacagctttattagg

SEQ ID NO: 68969 - DNA, 201 bp, Homo sapiens
cttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctg

SEQ ID NO: 68970 - DNA, 201 bp, Homo sapiens
ccaaaattacccagtagagcctgcattttaaacccaaaatctgtccacttaactaataagttgtaaaaagcctgatagtctgtctcctaaccagtatgctsaactgactttataaaagtagtaattctttggatttgttttctcgaaattgagcttcattgggaaattaaaaacagaaacttttctttttttgtataagca

SEQ ID NO: 68971 - DNA, 201 bp, Homo sapiens
ttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctgg

SEQ ID NO: 68972 - DNA, 201 bp, Homo sapiens
ctttttactcacctattttcagaccgctattgacagtggctaactgtaagcatggaaaatgaaaccatggatgaggggggactactgtataaagctgtatrtagctcttacaaatcaataagaaaggccaataacccaataggaaaatgagcaaaaggaaaacagatcatttgtagaaagggagaaatgtctcaaacatta

SEQ ID NO: 68973 - DNA, 201 bp, Homo sapiens
caagccacaaaaccagcaagtttttattagtgattttcaaaaggggagggagtgtatgaatagggtctgggtcacagagatcacatgcttcacaaggtaayaagatatcacaaggcaaatggaggcagggtgagatcacaggaccggggcaaaactaaaattgctaatgaagttttgggcacatattgtcattgataacat

SEQ ID NO: 68974 - DNA, 201 bp, Homo sapiens
cggggcaaaactaaaattgctaatgaagttttgggcacatattgtcattgataacatcttatcaggagacagggtttgagagcaggcaaccggtctgaccraaatttattaggcaggaatttcctagtcctaataagcctgggagtgctacgggagactggggctaatttcatccctacagctgcgaccgtaaaagacagc

SEQ ID NO: 68975 - DNA, 201 bp, Homo sapiens
ctggtgctctgttttactgtggctgagctggcacccaggctacaagacagcatccttcccattcttccctcccctttttccaggcagatgattctttcccygtgtccaccactaccacaggcccacaaggagttctgtcagggtaccacaaatgtttacttaaggcccaagggctcttcagtcagcttgtgttgaatactg

SEQ ID NO: 68976 - DNA, 201 bp, Homo sapiens
cgggtaggtccagagattctgtccaggagccagggcctggagttggaaaccttaggaataatcctggtgctctgttttactgtggctgagctggcacccargctacaagacagcatccttcccattcttccctcccctttttccaggcagatgattctttccccgtgtccaccactaccacaggcccacaaggagttctgt

SEQ ID NO: 68977 - DNA, 201 bp, Homo sapiens
cattctcccgcctcagcctcacgcgtagctgggactacaagtgctcgccaccatgcccagctaattttttgtatttttagtagagacagggttttaccgtstattgcatgttttttatgtgctagatgctttacatataattacttcatgtaatcttcgtaaatcctctgagaaatacctagttttagctgtatcgtacaa

SEQ ID NO: 68978 - DNA, 201 bp, Homo sapiens
aatatcttcagctttgcaagccagacagtctctgttacaagcgctcgactcccccttgtagcatgaacacagctgtagataatacgtccaggaatgggtgyggctctgtgccaataaaactttattgtccaaaaacaggtgacaggttggtttggctcataggctgtagtctgccacttcctgttttattctaccttctgt

SEQ ID NO: 68979 - DNA, 201 bp, Homo sapiens
ctccccgtcctggggatgggggcggtgtccactgacctaatcaggttcgagctaaagtccctgcgtagctggtcgtctctggcttcctgggcagggtgcarcctcacccccgtgctggtttcctaaggctgctataattaattatcacaaagtgagtggcttaaaacgatgcaagttattatcttacagttctggagatca

SEQ ID NO: 68980 - DNA, 201 bp, Homo sapiens
gtcagcttcctttgctgttcccgggcttccctcagctctatctcaagccatgacctctgcttccatgtctgcagccccatgaggctggggctgctctgtcytgcatatctccagtgcctggcaaggggctggcaagaggtagaggctcattaaatgcctgttaaaaccctaatagtaataataataatggtacagttgtta

SEQ ID NO: 68981 - DNA, 201 bp, Homo sapiens
accatcccttaaaccagaggtcagcaaacttttccccctcaggaacagatggtaaatatcttcagctttgcaagccagacagtctctgttacaagcgctcractcccccttgtagcatgaacacagctgtagataatacgtccaggaatgggtgtggctctgtgccaataaaactttattgtccaaaaacaggtgacaggt

SEQ ID NO: 68982 - DNA, 201 bp, Homo sapiens
gcgatcgtcttcttcaactaccacatcctggcctccctgcgaacgcgggaggaggtcagcaggacaaggtgcgggggccgcaaggatagcaagaccacagygctgatcctcacgctcgtggttgccttcctggtctgctgggccccttaccacttctttgccttcctggaattcttattccaggtgcaagcagtccgaggc

SEQ ID NO: 68983 - DNA, 201 bp, Homo sapiens
acacagaccattaataccatctaacagatgttagttgttatccttatttattactcatgctttcctttctattttttcttttctctctctctctctccttytttttttttttttttttgttgttgttgttgttgagacagggtctcagtccgtcggcccagactgaagtgcagtggcacaatcatagctcgctgcagcctc

SEQ ID NO: 68984 - DNA, 201 bp, Homo sapiens
aacacagaccattaataccatctaacagatgttagttgttatccttatttattactcatgctttcctttctattttttcttttctctctctctctctcctyttttttttttttttttttgttgttgttgttgttgagacagggtctcagtccgtcggcccagactgaagtgcagtggcacaatcatagctcgctgcagcct

SEQ ID NO: 68985 - DNA, 201 bp, Homo sapiens
caggaacagatggtaaatatcttcagctttgcaagccagacagtctctgttacaagcgctcgactcccccttgtagcatgaacacagctgtagataatacrtccaggaatgggtgtggctctgtgccaataaaactttattgtccaaaaacaggtgacaggttggtttggctcataggctgtagtctgccacttcctgttt

SEQ ID NO: 68986 - DNA, 201 bp, Homo sapiens
ggaacacagaccattaataccatctaacagatgttagttgttatccttatttattactcatgctttcctttctattttttcttttctctctctctctctccttttttttttttttttttttgttgttgttgttgttgagacagggtctcagtccgtcggcccagactgaagtgcagtggcacaatcatagctcgctgcagc

SEQ ID NO: 68987 - DNA, 201 bp, Homo sapiens
gagaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatg

SEQ ID NO: 68988 - DNA, 201 bp, Homo sapiens
agaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatgg

SEQ ID NO: 68989 - DNA, 201 bp, Homo sapiens
ttatttattactcatgctttcctttctattttttcttttctctctctctctctccttttttttttttttttttttgttgttgttgttgttgagacagggtytcagtccgtcggcccagactgaagtgcagtggcacaatcatagctcgctgcagcctcgaccttccaggcttaaacgattctcccacctcagcctctcgag

SEQ ID NO: 68990 - DNA, 201 bp, Homo sapiens
ctgccaggaagattaaatgagaaaatacttaaatgtgaaacacttagaatggcgcctggaacacagaccattaataccatctaacagatgttagttgttawccttatttattactcatgctttcctttctattttttcttttctctctctctctctccttttttttttttttttttttgttgttgttgttgttgagacagg

SEQ ID NO: 68991 - DNA, 201 bp, Homo sapiens
aaatgtgaaacacttagaatggcgcctggaacacagaccattaataccatctaacagatgttagttgttatccttatttattactcatgctttcctttctmttttttcttttctctctctctctctccttttttttttttttttttttgttgttgttgttgttgagacagggtctcagtccgtcggcccagactgaagtgc

SEQ ID NO: 68992 - DNA, 201 bp, Homo sapiens
gtccccaccccggccaccacactggtcccagccccaacaggtcagcttcctttgctgttcccgggcttccctcagctctatctcaagccatgacctctgcytccatgtctgcagccccatgaggctggggctgctctgtcctgcatatctccagtgcctggcaaggggctggcaagaggtagaggctcattaaatgcctgt

SEQ ID NO: 68993 - DNA, 201 bp, Homo sapiens
ggaggaaggaaggaaggaaggagggaaggagggtagggagggaaggagagaaggagggaatgaagggaaggaaggaaggaaggggaaaaaatccaacaaartggttatattatattgatggtgttataaagtagttctagataaaaactattttcaaaaaagtctttaaatatatatgcatacacctatgaatattaaagc

SEQ ID NO: 68994 - DNA, 201 bp, Homo sapiens
gaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatggt

SEQ ID NO: 68995 - DNA, 201 bp, Homo sapiens
aggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaaatggtt

SEQ ID NO: 68996 - DNA, 201 bp, Homo sapiens
cagctgcgtggctatgaacatgagctatggggtgcatgcagaccaaggttcatagtgtacactgtacccaccagctgtagctcctccagcaagcgtgggargccagtcagctgcatggctgtgagcacggcctctggggtccatgcagaccaaggttcctggcgtagcactgtaaccaccacctaggtcttctccgacaag

SEQ ID NO: 68997 - DNA, 201 bp, Homo sapiens
taatgtttgccacgtgcttacaataagtcaggaaccctgccaagcaccgggcgtatattaacctatccaagctggggaagaatgtttaggctctgaagatwgtctggagccgcataaatcccgcagtgtaggcagctgctcattctgcagatagtattctgtggatccctgagttggctgtggccggttttgccagcagga

SEQ ID NO: 68998 - DNA, 201 bp, Homo sapiens
tagagctccaatcctccaaccagagccagctcttccctcaaaatgctacggcctgtgacaatgctccagaagcctgggacctgctgcacagagtgctgccracatttatcatctccatctgtttcttcggcctcctagggaacctttttgtcctgttggtcttcctcctgccccggcggcaactgaacgtggcagaaatct

SEQ ID NO: 68999 - DNA, 201 bp, Homo sapiens
caaggttaattctctgctacacaatagcttttgttggtatctgtgaggctttgcggggttgaaggaatctcaggtgtcacccattaataacaatcatgacrgtgacaactaatgtttgccacgtgcttacaataagtcaggaaccctgccaagcaccgggcgtatattaacctatccaagctggggaagaatgtttaggct

SEQ ID NO: 69000 - DNA, 201 bp, Homo sapiens
gatctgaacatcaccgcctgcatcctgctcctcccccatgaggcctggcactttgcaaggattgtggagttaaatattctgggtttcctcctaccactggytgcgatcgtcttcttcaactaccacatcctggcctccctgcgaacgcgggaggaggtcagcaggacaaggtgcgggggccgcaaggatagcaagaccaca

SEQ ID NO: 69001 - DNA, 201 bp, Homo sapiens
atataatttaaagcaaccacatctccacagcacttcccagaagagaaaactcctccaaaagcagctctcactatcagaaaacccaactacagttgtgaacrccttcattttctgcctgagtaagtaaatgaccaccttttttttttcttttatgagagtacaatatgagaggaaatctgtgtctcttagaaaaacaaaaaa

SEQ ID NO: 69002 - DNA, 201 bp, Homo sapiens
gagtgacatgacagaatgtcagagctagaagggcctcttgaggacatcatgtcttccttagatgaggaaagtcaggctcagagacatgaactgactctccygaggttacacagccaaatatgctcttccaaggttaattctctgctacacaatagcttttgttggtatctgtgaggctttgcggggttgaaggaatctcag

SEQ ID NO: 69003 - DNA, 201 bp, Homo sapiens
gccctcccgtgatcccacaagagagacacgattctctccaatgtttaaaaaggaaagtaaaagtcaatggttctaagtagctcacactgagtgattgtacygggatttggactcaggcaccatcccttaaaccagaggtcagcaaacttttccccctcaggaacagatggtaaatatcttcagctttgcaagccagacagt

SEQ ID NO: 69004 - DNA, 201 bp, Homo sapiens
tgaatcagactgcctgggtttgaatccaggccctactgaccagctgtgtgacctcagacaggcgactccgggtctcagcactcaattttctaattggccarctggagatgacaatggcccctaccttgaatggctgccaggaagattaaatgagaaaatacttaaatgtgaaacacttagaatggcgcctggaacacagac

SEQ ID NO: 69005 - DNA, 201 bp, Homo sapiens
ctgaaaatcacggtgttactacctccaaaacacctctagagtttgatcacttgatcacttctcaccacctgccctgctactctccccagctgtcacccgcyagcatgtttatttagtgtgtgtattgtttatcaacttcttcctcctgctaggcttatacgcacactgagagcagggatttttgcctgctgtattcactgc

SEQ ID NO: 69006 - DNA, 201 bp, Homo sapiens
tttttgtgttttcagtagagacaaagtttcaccatgttggccaggttggtcttgaactcctgacctcatgtgatccacctgcctcagcctcccaaagtgcwgggattacaggcatgagccacaccgtgcccagcccacacgtatttttttttaaccagattaaacctttcaaataagttgtacctacttataagttttgaa

SEQ ID NO: 69007 - DNA, 201 bp, Homo sapiens
ttgcaaggattgtggagttaaatattctgggtttcctcctaccactggctgcgatcgtcttcttcaactaccacatcctggcctccctgcgaacgcgggargaggtcagcaggacaaggtgcgggggccgcaaggatagcaagaccacagcgctgatcctcacgctcgtggttgccttcctggtctgctgggccccttacc

SEQ ID NO: 69008 - DNA, 201 bp, Homo sapiens; identical to SEQ ID NO: 26632

SEQ ID NO: 69009 - DNA, 201 bp, Homo sapiens
cttgctctaggactggaaatctggggtttattaccaaagtcattcaaattaatgaaatcatagcaactgtccaccttcatctccctgggaatttgctgtaygtagagttaacagtgtttagttattggaatttttatcataatagacttacacttcttagctttgaaatcttagagttattaaatctgagactggagattt

SEQ ID NO: 69010 - DNA, 201 bp, Homo sapiens
tctgtgctgcctggtgtgtgcagtggggttggtttagtgtctcccacaagtagccatacacatcatgcagttacagggcttaggacagagcctggtccacrctgagggaccgtcaatggcagcttgccacgtttccttcctttctgcgtgaagtgtgtagggctccctttctgtgttgccattttataaacaaggaagtca

SEQ ID NO: 69011 - DNA, 201 bp, Homo sapiens
gatcctcccacctgagcctcctaagtagctgggaccacatacgtgtcccaccatgcccagctaatttttacttttaatttttgtggagatgaggtctcacygtgttgcccaggctggactcagactcctggactcaagcagtcctcccgcgtccatccctcaaagtgttgggattacaggcatgagccaccaaaaccggct

SEQ ID NO: 69012 - DNA, 201 bp, Homo sapiens
tagcagacagtcacaactttaccttatttccaatctttggaaaacaaagggcttaaggtaaaaactttgtggagccattaagctggaagaggattcagctmtatctggtgaattttaaaatgttaaaaatattctatattgtcttcttccaggaactttcacattcattcagactttgtagtttccacatttatttgtcca

SEQ ID NO: 69013 - DNA, 201 bp, Homo sapiens
tggggtcttctggccagagcttgtcaccagccccatggcctctccaggcgtgctcatgcccacaacccgcggccagccccacgtggtgccgctcagccttytctgcccctcctgggaatctgtcattcgtgggtgcttcagagtaaaatcaatgagtttctgagcagaatgagtgagtgatctagtttctataaattaggc

SEQ ID NO: 69014 - DNA, 201 bp, Homo sapiens
accaggcagacagtctgcctaggacccagtgccgcaggcctggatcagaccccaggatcagaccttggggtcttctggccagagcttgtcaccagccccayggcctctccaggcgtgctcatgcccacaacccgcggccagccccacgtggtgccgctcagccttctctgcccctcctgggaatctgtcattcgtgggtgc

SEQ ID NO: 69015 - DNA, 201 bp, Homo sapiens
tctgcctaggacccagtgccgcaggcctggatcagaccccaggatcagaccttggggtcttctggccagagcttgtcaccagccccatggcctctccaggsgtgctcatgcccacaacccgcggccagccccacgtggtgccgctcagccttctctgcccctcctgggaatctgtcattcgtgggtgcttcagagtaaaat

SEQ ID NO: 69016 - DNA, 201 bp, Homo sapiens
agcgcacggtggccaaggagcttgcccacaccggggatcccgacctcaccctgagctacctgtccatgtggctgcaccagccctatgtggagagcgacagyaggctgcatctggagagcatgctgctggagacaggccaccgagctctctgacgtcctgagacggctgcggacactggctccttccacgtctcaccaggca

SEQ ID NO: 69017 - DNA, 201 bp, Homo sapiens
atgttcttgaatcactgccattaagggagattcacgtttctttcagatgaggtttcgcataagctcttggagatgtacaggaaggagctgctcctgaagcrcacggtggccaaggagcttgcccacaccggggatcccgacctcaccctgagctacctgtccatgtggctgcaccagccctatgtggagagcgacagcagg

SEQ ID NO: 69018 - DNA, 201 bp, Homo sapiens
tggcctcctgaagtgctgggattacaggcgtgagccactgccctcggtccaacttcttatcttggcctattaggttctagttgtctgatcacctactcacrcactagtccttttctgtctatttcattccagcacactggtttttttgtttgcttgtttgttttgttttgttttctgttttttgaactcaccaacctcatt

SEQ ID NO: 69019 - DNA, 201 bp, Homo sapiens
gagacggctgcggacactggctccttccacgtctcaccaggcagacagtctgcctaggacccagtgccgcaggcctggatcagaccccaggatcagacctyggggtcttctggccagagcttgtcaccagccccatggcctctccaggcgtgctcatgcccacaacccgcggccagccccacgtggtgccgctcagccttc

SEQ ID NO: 69020 - DNA, 201 bp, Homo sapiens
tcctggcctcaagtgatccacccacctcagcctcccaaagtgttgggattacaggcgtgagccaccatgttcgtccaggaaatctttatctttggacaccraaattagaattttgtataatttttatgagtcacaatcactattgtccttttggttattttcaaccatttaaaaatgtaaaaaccatcttagcttatgggc

SEQ ID NO: 69021 - DNA, 201 bp, Homo sapiens
ggttgagaccagcctgggcaacatctacaaaaaatacaaaaaactaaccaggtgtcatggtgcatgcctgtggtcccaactactcaggaggctgaggtagratcacctgagcctgggacattgaggctgcagtgagccacgactgcaccactgcactgcagcctgggtgacagagcaaagccctgtggaaaaaaaaaaaaa

SEQ ID NO: 69022 - DNA, 201 bp, Homo sapiens
ttgtttaacaaattagacatttctggcagaggttatgtatatgatacactttttttgatagcagctgcaatgttggacagaagatgaaatgctttgctttsagtcagattcttatgaatatctgcttttccctgactttgagttaggtagctttggaagtagcattaattcagataaactgccatcatgctgcgttatgcc

SEQ ID NO: 69023 - DNA, 201 bp, Homo sapiens
tacaatataaatgttcagattgcttagagaaggaaattgggaaagtaaaaatctcgaaattacttgaaaagtggacaatattaagggactgtatcaataamaattttgatccttgtaaattacgttttaaaaagatgtttcttttaaaaactaagctctaatttaaaattacatcaattagaactgtaagaaatctcttga

SEQ ID NO: 69024 - DNA, 201 bp, Homo sapiens
ctcgtctcaaaaaaaagaaagaaaattagtaattgtaagtacccctgataagcaaattagtaattgtcaatacccctgttaagcaattcctttttgcagtrtatttctgaaatgacagaatgctgttttaaaaacaaagaaataaaatcctgctcctgactcggtcaaaatattttttaaagtctattgtttgttgtgctt

SEQ ID NO: 69025 - DNA, 201 bp, Homo sapiens
cattttaaatatgtgcagtttattgaattttgataatccctaaatgaaggtgtaaaacgacaccaatataaaaataaataaatgggccaataaggatcatyagatatttaaagaaagctccaataagaaatataaacatcagagggtggcaccaagatggccgaataggaacagctccagtctgcagctcccagtgtgaag

SEQ ID NO: 69026 - DNA, 201 bp, Homo sapiens
ttttgcagtatatttctgaaatgacagaatgctgttttaaaaacaaagaaataaaatcctgctcctgactcggtcaaaatattttttaaagtctattgttygttgtgcttgctggtactaagaggctatttaaaagtataaaactgctttgtatccatgagggtttcattgtgtgttagcagcagtgagcttctattaaat

SEQ ID NO: 69027 - DNA, 201 bp, Homo sapiens
ggtgcagcccacagagctgggcagggcattgcctcaccaaggaagcacaaggggtgggggaattccctttcctagcaaagggaagccatgacagacagcasctggaaaatcgggacactcccaccctaatactgctcttttccaacagccttagcaaatggcacaccaggagattatatcccgcggctggcttggaggctc

SEQ ID NO: 69028 - DNA, 201 bp, Homo sapiens
agtataaaactgctttgtatccatgagggtttcattgtgtgttagcagcagtgagcttctattaaatgtatatgtcatttattttgtttaagtggctttcmgcaaacctcagtcatattcttatgcagggtattgcgaaacaacttgtgttctattaatcgtgtcttcaattaaaagaccacagacttctggaaactcttt

SEQ ID NO: 69029 - DNA, 201 bp, Homo sapiens
ggtaataacaaacttctccgagctaaaggaggatgtttgaacctatcacaaagaagctaaaaaccttgaaaaaagagtagacgaatggcagtgtagagaawagacaatgtagagaagtccttaaatgacctgatggagctgaaaatcatggcacaaggactacgtgacgcatgtacaagcttcagtagccgatttgatcaa

SEQ ID NO: 69030 - DNA, 201 bp, Homo sapiens
gggacacagggtggggaacatcacacacacgggcctgccggggggtgggcgggggagggatagcattaggagatatacctaatgtaaatgacgagttgacrggtgcagcacaacaacatggcgcacgtattcctatgtaacaaacctgcacattgtgcacatgtaccctagaaccttaagtaaaataataaaataaaaata

SEQ ID NO: 69031 - DNA, 201 bp, Homo sapiens
ggggaacatcacacacacgggcctgccggggggtgggcgggggagggatagcattaggagatatacctaatgtaaatgacgagttgacaggtgcagcacamcaacatggcgcacgtattcctatgtaacaaacctgcacattgtgcacatgtaccctagaaccttaagtaaaataataaaataaaaataaaaaagaaatat

SEQ ID NO: 69032 - DNA, 201 bp, Homo sapiens
gacaaaatttaacagctcttcatgctgaaaactctcaataaactaggtattgatgggatgtatctcaaaataatatgatctatttatgacaaacccacagscaatatcatactgaatgggcaaaaactggaagcattccctttgaaaatgggcacaagatagggatgccctctctcaccactcctattcaacagagtgttg

SEQ ID NO: 69033 - DNA, 201 bp, Homo sapiens
cccacaggcaatatcatactgaatgggcaaaaactggaagcattccctttgaaaatgggcacaagatagggatgccctctctcaccactcctattcaacakagtgttggaagttctggccagggcaatcagggaagagaaagaaataaagggtattcaattaggaaaagaggaagtcaaattgtccctgttgcagaggaca

SEQ ID NO: 69034 - DNA, 201 bp, Homo sapiens
ccactcctattcaacagagtgttggaagttctggccagggcaatcagggaagagaaagaaataaagggtattcaattaggaaaagaggaagtcaaattgtycctgttgcagaggacatgattgtatatttagaaaaccccaacatctcagcccaaaatctccttaagctgataagcaacttcagcaaaatctcaggataca

SEQ ID NO: 69035 - DNA, 201 bp, Homo sapiens
ataacagacaaacggagagacaaatcatgagtgaactccattcacagttgcttcaaagagaataaaatacctaggaatccaacttacaagggatgtgaagkacctcttcaaggagaactacaaaccactgctcagcaaaataaaacaggacacaaagaaatggaagaacatttcatgctcgtggataggaagaatcaatgt

SEQ ID NO: 69036 - DNA, 201 bp, Homo sapiens
agagaataaaatacctaggaatccaacttacaagggatgtgaaggacctcttcaaggagaactacaaaccactgctcagcaaaataaaacaggacacaaasaaatggaagaacatttcatgctcgtggataggaagaatcaatgttgtgaaaatggccatactgcctgaggtaatttatagattcaatgccatccccatca

SEQ ID NO: 69037 - DNA, 201 bp, Homo sapiens
ggaatccaacttacaagggatgtgaaggacctcttcaaggagaactacaaaccactgctcagcaaaataaaacaggacacaaagaaatggaagaacatttyatgctcgtggataggaagaatcaatgttgtgaaaatggccatactgcctgaggtaatttatagattcaatgccatccccatcaagctaccaatgactttc

SEQ ID NO: 69038 - DNA, 201 bp, Homo sapiens
gggtgaaggatatgaacagacacttctcaaaagaagacatttatgcagccaacagacacatgaaaaaatgctcatcatcactggccatcagagaaatgcamatcaaaaccacaatgagataccatctcatgccagttagactggcaatcattaaaaagtcaggaaacaacaggtgctggagaggatgtggagaaataggaa

SEQ ID NO: 69039 - DNA, 201 bp, Homo sapiens
aatagagccctcagaaataataccacacatctacaaccatctgatctttgacaaacctgacaaaaacaagaaatggggaaaggattccctatttaataaayggtgctgggaaaactggctagccatatgtagaaagctgaaactggatcccttccttacaccttatacaaaaatcagttcaagtgggattaaagacttaaa

SEQ ID NO: 69040 - DNA, 201 bp, Homo sapiens
gatctgagaaaggaaagactgcctcctcaagtgggtccctgacccctgagtagcctaactgggaggcacctcccagtaggggccgacagacacctcatacagggggatgcccctctaagacaaagcttccagaggaaggatcagacagcaacatctgctgttctgcaatattagctgttcttcagcctctgctggtgatac

SEQ ID NO: 69041 - DNA, 201 bp, Homo sapiens
aaaaaatgctcatcatcactggccatcagagaaatgcacatcaaaaccacaatgagataccatctcatgccagttagactggcaatcattaaaaagtcagkaaacaacaggtgctggagaggatgtggagaaataggaacacttttacactgttggtgggactgtaaagtagttcaaccattgtggaagacagtggggcaa

SEQ ID NO: 69042 - DNA, 201 bp, Homo sapiens
ttaggagatatacctaatgtaaatgacgagttgacaggtgcagcacaacaacatggcgcacgtattcctatgtaacaaacctgcacattgtgcacatgtamcctagaaccttaagtaaaataataaaataaaaataaaaaagaaatataaacattaaaagatattttttaacaaaagggatctgaaggaaatgaagaccac

SEQ ID NO: 69043 - DNA, 201 bp, Homo sapiens
atcccagcactttgggaggccgaggcaggcagatcacaaggtcaggagttcgagaccagcctgaccaacatggtgaaaccctgtctctactaaaaatacaraaattagccgggggtggtgacatgtgcctgtaatcccagctactcaggaggctaaggcaggagaatcgcttaaacccaggaggcggaggttgcagtgagc

SEQ ID NO: 69044 - DNA, 201 bp, Homo sapiens
ttaacaaaagggatctgaaggaaatgaagaccacaacagaaggagaattttgaaaagaaaccagaaaagagaaagctgtaaatagcatcctcagagataasgatggatattacatcaatgaaacaaaagcaggatgctataaaagaagattcagaaagcaagatctcttgaaaattaaaaatatgattgtagaagttgttt

SEQ ID NO: 69045 - DNA, 201 bp, Homo sapiens
ccagaaaagagaaagctgtaaatagcatcctcagagataacgatggatattacatcaatgaaacaaaagcaggatgctataaaagaagattcagaaagcamgatctcttgaaaattaaaaatatgattgtagaagttgtttttttatggaaaagttggtagattaggaaatttcatagaagttaaataattaaagagatta

SEQ ID NO: 69046 - DNA, 201 bp, Homo sapiens
aggatgctataaaagaagattcagaaagcaagatctcttgaaaattaaaaatatgattgtagaagttgtttttttatggaaaagttggtagattaggaaayttcatagaagttaaataattaaagagattaaaaatagtgaaaatatatataaacacaagattaataaaagcgttttgggagaggaaagcagagaaaatgg

SEQ ID NO: 69047 - DNA, 201 bp, Homo sapiens
tagccacattagcggttagaatacaatgaaataatgcctttataattctgaataaaaataatgtgtttagaactatgctcagaaacaaaaggtctcagtckttcatgtgtccattctcaggaagctactgcagtatatgttccatcaaaataaggacgtaaatcaagaaaactagaacagtatttttaaaatggaagaatg

SEQ ID NO: 69048 - DNA, 201 bp, Homo sapiens
gaaaactagaacagtatttttaaaatggaagaatgatgggagtatttctcaatatgaaagcaaaaggataaaaacaactacgtagcaatcctagaaagcartcagtttggagaaaagcagaaggtcagaggctataggagaaagatttccatgagaatgggcagtgagaggggaagttggaaataagaaggaaatattatc

SEQ ID NO: 69049 - DNA, 201 bp, Homo sapiens
ttgcctgtaatcccagcactttgggaggccgaggcaggcagatcacaaggtcaggagttcgagaccagcctgaccaacatggtgaaaccctgtctctactraaaatacaaaaattagccgggggtggtgacatgtgcctgtaatcccagctactcaggaggctaaggcaggagaatcgcttaaacccaggaggcggaggtt

SEQ ID NO: 69050 - DNA, 201 bp, Homo sapiens
atcagcaaaatccaggatgtgggaaattctacacaacaaatgcccccattttttaaatatcagtaatgtgaaaaataacggacagaaaattgtaaattaamgagtcacacagagcaaccaaatgcaatcttgtttagatcctgaatccaacaaaccagttaaattttttttttgtagacaactggaaaacgtgaatgctga

SEQ ID NO: 69051 - DNA, 201 bp, Homo sapiens
actatctataaattagagcagatgataaccaccgtagaggtgtgaagatgaagtgagatatcacatattattccacatccagactgatgttttaaagttgygggacagtttttctccaactgtagtgtgtatgcaattgctaaggaaagatcatttttgaaatgcagattttgatagagtggatccaaggtggggcctgag

SEQ ID NO: 69052 - DNA, 201 bp, Homo sapiens
gaccccacaacaggccctggtgtgtgatgttccccttcctgtgtccatgtgttctcattgttcaattcccacctatgagtgagaacgtgcagtgtttcgayagaagattttccttataacattagggtaagagaggatccattttgaatgttatgtttggcacccttaacatcttagagaaacaaaaaaggttatgaaaat

SEQ ID NO: 69053 - DNA, 201 bp, Homo sapiens
agcagcttacggcggttttgcagtcatatttatacccacttttaactacatgcagattaagggatggtttatgcggaaatttcaagggaagtggtagtaayttttgggtcatctggtcattgccctggaaagaggcagtaactcctgggtgttgttatagcaatggtaaactgacatggcacactagggggcgtgtcttat

SEQ ID NO: 69054 - DNA, 201 bp, Homo sapiens
taatttcccgtgttggcaattttaagaagaccagagccactaaatcatttctagaggagtatggattattacgacctttatagagtagaatttgtctatayagctcagaagtctttaaaatgtgcatacacatcactatttcctgaagtatgactttatcctgaagagtcctcccactaaaagacaactagaacttagata

SEQ ID NO: 69055 - DNA, 201 bp, Homo sapiens
ggacaatattaagggactgtatcaataaaaattttgatccttgtaaattacgttttaaaaagatgtttcttttaaaaactaagctctaatttaaaattacrtcaattagaactgtaagaaatctcttgatttcagtgctggattattctttgcagaaaatttgagaagcaatgggcatcctgaagctgcaagtatttctca

SEQ ID NO: 69056 - DNA, 201 bp, Homo sapiens
agaggagtatggattattacgacctttatagagtagaatttgtctatatagctcagaagtctttaaaatgtgcatacacatcactatttcctgaagtatgrctttatcctgaagagtcctcccactaaaagacaactagaacttagataagttaagacaaacatatttttatggctaagctcacagaaaggaaaagaaatc

SEQ ID NO: 69057 - DNA, 201 bp, Homo sapiens
tgaggcaggagaatggcgtgaacccaggaggcagagcttgcagtgagccgagatcgtgccactgcactccagcctgggcgacagagcgagactccgtcttaaaaaaaaaaaaaaaatcaatggacttcttacctctccttacatacttaaacaagagaaaagaagaagcatgtgtcaacacaaagacttgtacatgaatat

SEQ ID NO: 69058 - DNA, 201 bp, Homo sapiens
taatgtgaaaaataacggacagaaaattgtaaattaaagagtcacacagagcaaccaaatgcaatcttgtttagatcctgaatccaacaaaccagttaaattttttttttgtagacaactggaaaacgtgaatgctgaatgaatatttatattaaggaattcccataaattgtatgtttagatgggataatggtttcagag

SEQ ID NO: 69059 - DNA, 201 bp, Homo sapiens
accattccttctgaaactattccaatcaatagaaaaagagggaatcctccctcagtcattttatgaggccagcatcatcctgataccaaagcctggcagaracacaacaaaaaaagagaattttagaccaatatccctgatgaacatcgatgcaaaaatcctcaataaaatactggcaaaccgaatccagcaacacatcaa

SEQ ID NO: 69060 - DNA, 201 bp, Homo sapiens
agtaaaatttaaaaaaaaaacagtttcacatgagattattaaatatttactcttaggctatctctacttagagatagagataatgaaatactccccacacmaggtaaacacaatgagataaatccattgcatttgagtcccagattatgcatatccactggctcctggacattgagtttttagccctataactatttcatt

SEQ ID NO: 69061 - DNA, 201 bp, Homo sapiens
ggtttcaggagtgtgtgcattggccaaaaccagtcaaattatacattttaaatatgtgcagtttattgaattttgataatccctaaatgaaggtgtaaaaygacaccaatataaaaataaataaatgggccaataaggatcatcagatatttaaagaaagctccaataagaaatataaacatcagagggtggcaccaagat

SEQ ID NO: 69062 - DNA, 201 bp, Homo sapiens
ctaaagataacaatagaagaacgggcacagtgggatacaaaagaaaaaaagggagagagaaaaaggaaggagagaggtaagaaaaaaatgagtcatgatcwtatttgaaaaggtaacattcagagcttttgaaaaagcattaaatgtgacatagaaaagtagtttaaatatactaaagggaacaattcacagtaaagatat

SEQ ID NO: 69063 - DNA, 201 bp, Homo sapiens
agacaaacaggcagaaacatttaaataatagtagcttaattctcatgcagtccaagttctagtaaggtaaaaagtataaagaaggatttgtaagacttaarttacatttttaataaagtagattgtatggagatctatagagtagtgagaacttttgtatcttaaacagaaaatatgccttttccagtgctcgtggaaact

SEQ ID NO: 69064 - DNA, 201 bp, Homo sapiens
ttcacatttgttccatgttaccagtcatcaggtggaaaagcggaaatgcaacactgccacatgtgcaacgcagcgcctggcaaattttttagttcattccrgcaacaactttggtgccattctctcatctaccaacgtgggatccaatacatatggcaagaggaatgcagtagaggttttaaagagagagccactgaatta

SEQ ID NO: 69065 - DNA, 201 bp, Homo sapiens
gtgatttctgcatttccaactgaggtaccaggttcatctcactggggcttgccagacaagtgggtgcagcccacagagctgggcagggcattgcctcaccmaggaagcacaaggggtgggggaattccctttcctagcaaagggaagccatgacagacagcacctggaaaatcgggacactcccaccctaatactgctctt

SEQ ID NO: 69066 - DNA, 201 bp, Homo sapiens
cacatttgttgttatccttacccttttctatcagttccttaccataacatacacttaattcttggaaattcactcatgtcttacaaagatggcaaattcamacttctgctgtgtatgacacaccattaactgcacaaggacactgtgtatttgctacgttaatatttactgatgagttaatgtaataatgacccatccgct

SEQ ID NO: 69067 - DNA, 201 bp, Homo sapiens
caaacttctgctgtgtatgacacaccattaactgcacaaggacactgtgtatttgctacgttaatatttactgatgagttaatgtaataatgacccatccrcttctgctgcctgtgaggtactttctatctatagggatggaaattaatgacagaggctctctgagctgcctgatgtcagagctgagaaaggtgtgagggg

SEQ ID NO: 69068 - DNA, 201 bp, Homo sapiens
tatatcaggaatacagaaaagatcctaaggacttctacagagaggttttaaacaatgaaatataaaaaatcaaaaactgcttttcttttagccacattagyggttagaatacaatgaaataatgcctttataattctgaataaaaataatgtgtttagaactatgctcagaaacaaaaggtctcagtctttcatgtgtcca

SEQ ID NO: 69069 - DNA, 201 bp, Homo sapiens
atatctttgatggaacttctgacagacaggaatggataattccagttttgtcaagaaatatactcttggaacttagaggggcaaagccagaacatgaagcrggaaaaaaatcaaaaggtagtaatttcttctatattaacctgatactgaaacaaaccagagaaacttaactaaagcatatatttttataccaagtggatt

SEQ ID NO: 69070 - DNA, 201 bp, Homo sapiens
tcctcagatgtctctggaaatgttaaaaacttttacatcttgtggaaatggaaatgtatagaaataatcaggagcaaattaatgtttttaagaaatgaaayctaaaagaagtagttaaaaagccatttgctgttgggggatttattctatattgctagctagctattctgtgagtgaaacagatttataaaaagttattct

SEQ ID NO: 69071 - DNA, 201 bp, Homo sapiens
ataatgtgtttagaactatgctcagaaacaaaaggtctcagtctttcatgtgtccattctcaggaagctactgcagtatatgttccatcaaaataaggacrtaaatcaagaaaactagaacagtatttttaaaatggaagaatgatgggagtatttctcaatatgaaagcaaaaggataaaaacaactacgtagcaatcct

SEQ ID NO: 69072 - DNA, 201 bp, Homo sapiens
tttgagtctgtctcaaggttagggagctgatgtgagtttcctatattacccttaatcccccatggagctaaagtgatcctagatgttagggaattctgtayagtggcaatgcaaccaaatcttttctcagggaatatttccaacataaacacttaggattcttacagattaagttaaaaaacagatgatcttataaacaaa

SEQ ID NO: 69073 - DNA, 201 bp, Homo sapiens
gattttccttataacattagggtaagagaggatccattttgaatgttatgtttggcacccttaacatcttagagaaacaaaaaaggttatgaaaatagaayaaataacaatgtaggtaataagcaagtatttttgtctaaatgaacactagaccatgagtcataaagctaagctttggtccaggattcagcattaactaga

SEQ ID NO: 69074 - DNA, 201 bp, Homo sapiens
aactttaaaatcctgtttctttgtaacttttgtaaagtgtgagaaaattagaattaaatactgtcaaataactacagccttagatttctgactatatcatrcttaagaacagtaccttcagctattccattgttccttgaattctgtgttctttaaagaataacaccagtggcaaataaatatctttgatggaacttctga

SEQ ID NO: 69075 - DNA, 201 bp, Homo sapiens
ctcccacctcagcctcccaagtagctgggaccacaggcacctgccaccatacccagctaattgttttatctttattttatagggaaagggtctccctatgwtgcccaggctggtgtcaaactcctgggctcaagccttcctcctgcctcagtcttccaaaattctgggattataagagtgagccactgaacccagaccatt

SEQ ID NO: 69076 - DNA, 201 bp, Homo sapiens
ctttctttctatcagaagcatttgctgatattgctgacattgaaacattaaaaggtaaagaatttcctatttctgggaaagttttatttatttagagaaaygcacacttggtgttaaattcatggtttatttcaaagaaaggctaaagggagaatgtattacaatataaatgttcagattgcttagagaaggaaattggga

SEQ ID NO: 69077 - DNA, 201 bp, Homo sapiens
gggagctgatgtgagtttcctatattacccttaatcccccatggagctaaagtgatcctagatgttagggaattctgtatagtggcaatgcaaccaaatcytttctcagggaatatttccaacataaacacttaggattcttacagattaagttaaaaaacagatgatcttataaacaaaaatcaaactactgtaactgag

SEQ ID NO: 69078 - DNA, 201 bp, Homo sapiens
ctaactcaaataaggtaacattttatttagaacaattttaaattatattattgaccttccaaccaattatcaaaataccactcagcatttagcatataaaktatttcacactgtgcttcagtcatatgctaaacatatcttggaacagatattacctttgaatcttctcaatttgacccataattttcctttattactttt

SEQ ID NO: 69079 - DNA, 201 bp, Homo sapiens
ttttaaaactgattatttctaattaaccaaaaaaggctacttaaaatggccaagaagtatttagaactaaactaacttaatctttgatattaaaatagtaytgaatgagtaacagcatatcagatacagatgaaagggatgatttgtgaacttgaaaatagattttaagaaattatacaggattatcacaaaaggcatcaa

SEQ ID NO: 69080 - DNA, 201 bp, Homo sapiens
ccaattatcaaaataccactcagcatttagcatataaagtatttcacactgtgcttcagtcatatgctaaacatatcttggaacagatattacctttgaaycttctcaatttgacccataattttcctttattactttttttgagatgtttggaccaaattccaatttttactgtttttcaagaaaagtaagtattttaga

SEQ ID NO: 69081 - DNA, 201 bp, Homo sapiens
ttcattttccatttaccctaagtttcaccaatattttgatttctatggagctgaaaactaaaacatttctctaactttcctaataatcagcaaagaggaascaatgttattattctgcatccatttccgatatcgttttaaaagcacattgaaacaaaaggctgtcaaaaaaatagagttggtatacaaataaatgtctta

SEQ ID NO: 69082 - DNA, 201 bp, Homo sapiens
ggacgtataaaaaggggaagtttggtcacagagacacacacacagggataatgcctcatgggaatgaagacaaaaatcaggtgatgctgcttctccaaacmaacaagattgccagcaaactaccagaagctagaaagaggcatggaacagccctcagatagaaccaaccctgctgacacctaatcttagacttcttgcctc

SEQ ID NO: 69083 - DNA, 201 bp, Homo sapiens
ataggcatttttcacttaataaacttaaaaatgtctgtgctacattttaaaggatggtagaaagaataattttttaaaagacaactctagattgttctctrgcaaagtgaatctgtgatacaaagagatgaaagtatgctggaaaaaatcattaagcttgctaatttgcagctttttacatagaaaatagtgttctttaag

SEQ ID NO: 69084 - DNA, 201 bp, Homo sapiens
ccactgaattacttgcccctttagaggacaatgtaactctatagttattgttttatgttctagtgatttcctgtataatttaacagtgcccttttcatctycagtgtgaatatatggtctgtgtgtctgatgtttgttgctaggacatataccttctcaaaagattgttttatatgtagtactaactaaggtcccataata

SEQ ID NO: 69085 - DNA, 201 bp, Homo sapiens
gtacccctgataagcaaattagtaattgtcaatacccctgttaagcaattcctttttgcagtatatttctgaaatgacagaatgctgttttaaaaacaaakaaataaaatcctgctcctgactcggtcaaaatattttttaaagtctattgtttgttgtgcttgctggtactaagaggctatttaaaagtataaaactgct

SEQ ID NO: 69086 - DNA, 201 bp, Homo sapiens
ttaaaaattaactttgaaacatgaaaagaagtctacaaacaataaatgaacaatattgaaaaaattaaaagaaaaataaaaagcggtttgttggagatacttttaaaatataaagatgcaaaccattaaatactgaattctaatacataagtctaaatacctaccaaagccacaaagagattcctgaaggaataaacatgt

SEQ ID NO: 69087 - DNA, 201 bp, Homo sapiens
tggactttaagaaagaccatccccgcatacttccttccaagcatccaggtaacaaccttctctaaccctaacaacagtttaatttctggataaattaaacktgatagactctaggtctgtggaaaccaatcaccataaagggaagaagaaaaacactagtttaaaaacagggaaaatcaactaaattataaaccctcttcc

SEQ ID NO: 69088 - DNA, 201 bp, Homo sapiens
agtgtctcactaataaatgtcaatggacttctaattagccaggcatggtggtgggcacctgtggtcccagctactcgggaggctgaggcaggagaatggcrtgaacccaggaggcagagcttgcagtgagccgagatcgtgccactgcactccagcctgggcgacagagcgagactccgtcttaaaaaaaaaaaaaaaatc

SEQ ID NO: 69089 - DNA, 201 bp, Homo sapiens
gcgacagagcgagactccgtcttaaaaaaaaaaaaaaaatcaatggacttcttacctctccttacatacttaaacaagagaaaagaagaagcatgtgtcarcacaaagacttgtacatgaatatttgttgcagctttatttgtaatagcctcaaactagaaacaacccgaagtccattaacaaaatggctaaacattttgt

SEQ ID NO: 69090 - DNA, 201 bp, Homo sapiens
aagtgggtccctgacccctgagtagcctaactgggaggcacctcccagtaggggccgacagacacctcatacagggggatgcccctctaagacaaagcttycagaggaaggatcagacagcaacatctgctgttctgcaatattagctgttcttcagcctctgctggtgatacccaggcaaacagggtctggagtggacct

SEQ ID NO: 69091 - DNA, 201 bp, Homo sapiens
acacctcatacagggggatgcccctctaagacaaagcttccagaggaaggatcagacagcaacatctgctgttctgcaatattagctgttcttcagcctcygctggtgatacccaggcaaacagggtctggagtggacctccagcaaactccaacagacctgcagttgagggtcctgactgttagaaggaaaactaacaaa

SEQ ID NO: 69092 - DNA, 201 bp, Homo sapiens
aacaaacttctccgagctaaaggaggatgtttgaacctatcacaaagaagctaaaaaccttgaaaaaagagtagacgaatggcagtgtagagaatagacartgtagagaagtccttaaatgacctgatggagctgaaaatcatggcacaaggactacgtgacgcatgtacaagcttcagtagccgatttgatcaaatagaa

SEQ ID NO: 69093 - DNA, 201 bp, Homo sapiens
agtgtagagaatagacaatgtagagaagtccttaaatgacctgatggagctgaaaatcatggcacaaggactacgtgacgcatgtacaagcttcagtagcygatttgatcaaatagaagaaagggtatcagtgattgaagatcaaatgaatgaaatgcagggagaagagaagtttagagaaaaaagagtaaaaagaaatga

SEQ ID NO: 69094 - DNA, 201 bp, Homo sapiens
aacactcttcaggatatcatgccggagaacttccccaacctagcggggaaggccaacattcaaattcagaaaatacagagaatgccacaaagatactcctygagaagagaaactccaagacacataattgtcagattcaccaaagttgaaatgaaggaaaaaatgttaagggcagccagagagaaaggtcaggttacccac

SEQ ID NO: 69095 - DNA, 201 bp, Homo sapiens
gattcaccaaagttgaaatgaaggaaaaaatgttaagggcagccagagagaaaggtcaggttacccacaaagggaagcccattagactaacagtgagcggstctctcggcagaaactctacaagccagtagagagtgggggccaatattcaacattcttaaagaaaagaattttcaacccagaatttcatacccagtcaaa

SEQ ID NO: 69096 - DNA, 201 bp, Homo sapiens
acttagactcccacacaataataatgggagacattaacaccccactgtgaacattagacagatcaacaagacagaaagttaacaaggatatccaggaattwaactcagctctgcaccaagcggacctaatagacatctacagaaccctccaccccaaaacaacagaatatacattcttctcagcaacacatcacacttatt

SEQ ID NO: 69097 - DNA, 201 bp, Homo sapiens
tgtgaacattagacagatcaacaagacagaaagttaacaaggatatccaggaatttaactcagctctgcaccaagcggacctaatagacatctacagaacyctccaccccaaaacaacagaatatacattcttctcagcaacacatcacacttattccaaaatggaccacatagttggaagtaaagcactcctcagcaaat

SEQ ID NO: 69098 - DNA, 201 bp, Homo sapiens
acaaaaaccacatgattatctcaatagatgaagaaaaggcctttgacaaaatttaacagctcttcatgctgaaaactctcaataaactaggtattgatggkatgtatctcaaaataatatgatctatttatgacaaacccacaggcaatatcatactgaatgggcaaaaactggaagcattccctttgaaaatgggcacaa

SEQ ID NO: 69099 - DNA, 201 bp, Homo sapiens
gaatgctgttttaaaaacaaagaaataaaatcctgctcctgactcggtcaaaatattttttaaagtctattgtttgttgtgcttgctggtactaagaggcwatttaaaagtataaaactgctttgtatccatgagggtttcattgtgtgttagcagcagtgagcttctattaaatgtatatgtcatttattttgtttaagt

SEQ ID NO: 69100 - DNA, 201 bp, Homo sapiens
gccatcagctgagctcatcccccgtgcactccacaacgctgaggctctgcacatggctcaccagtgccaggtgctgccagtcagcagtgccgtgctgtttscacagcagcctgcatacgtctatattgcccagcccgtttcacctggcggggtcacacaaaccaccccctggtattgttagcacgtccacataatggcatc

SEQ ID NO: 69101 - DNA, 201 bp, Homo sapiens
acgctgaggctctgcacatggctcaccagtgccaggtgctgccagtcagcagtgccgtgctgtttgcacagcagcctgcatacgtctatattgcccagccygtttcacctggcggggtcacacaaaccaccccctggtattgttagcacgtccacataatggcatctccacagctgtgtcatccagaagaaacccatagcc

SEQ ID NO: 69102 - DNA, 201 bp, Homo sapiens
actgaccaggggctgctgtgaatgctgtttggagaaatcggggctgggggtaggcagggttatgttttgaatttctgagaccagagcttctttctgtggcrttgtaacagctgtgctttgcctcctagagtcttagagagcctccttgtgtctctggtaaccaccgtggtggtgtttgtggcctcgatggtgttaggagaa

SEQ ID NO: 69103 - DNA, 201 bp, Homo sapiens
gctcactgcagcctcagcctcccaggctcaagcgatcctcccacctcagcttcttgagtagctgggaccataggcatataccttttgtactttttgtagcracatggtctcactacattgcccaggctggcctccaactcttaggctcaagtgatcctcctgcctcagcctcccaaagtgttgggattacaggcatgagcc

SEQ ID NO: 69104 - DNA, 201 bp, Homo sapiens
tttcaccctgcccagggctcttcgtggggaaggaaggccccatgatccacagtggttcggtggtgggagctggcctccctcaggtaagatgggctgagagrgtgtgggcctctgggcaggcctagtgggaggtctggttacactgggccaaatccattgggacaccctgacatcacattggaacctggtgccattctggct

SEQ ID NO: 69105 - DNA, 201 bp, Homo sapiens
catccagcgagctacggaacatgtgtgatgagcacatcgcctctgaggagccagccgagaaggaggacctcctgcagcagatgctggaaaggaggtgagarcctggcggggcccccactgcccgcagggctacacagcggtggggtgagcctttggctcagatgttgtgaggtggctcctgagtttcctgggaaagttgga

SEQ ID NO: 69106 - DNA, 201 bp, Homo sapiens
gagacaagcggtcccgtctcacacggcttagtgctttgcccacccctggctggggtggacttaccggctctcaggggaagttggcactgttctcatcacaygcgacagggagagtagatttgacagcaggggcagctttatcaggccgtgaagatgtgtgtgcgttcttgccgcaatgagcatgtggacagatctgttttt

SEQ ID NO: 69107 - DNA, 201 bp, Homo sapiens
ttttaacctcacctttgtcttcctggcaagcctccttgttctcattgaggtgaggtggtttggattcacctgctcgcttaggaggttttagagtcccgcaytccttttccccacctccttccagaatgtcaggaaactgagaatgcagattcctgcagaaagtggcctcttgttcactaaaggtaaaggtttcacctctgg

SEQ ID NO: 69108 - DNA, 201 bp, Homo sapiens
tcttgaactcctgaactcaagtgattcacctgcctcggcctcccaaagtgctgggattacatgcgtcagccactgcacccggcctcagtcttttcttctaygcggcacaaccctggcatgcatagtgcgtacttacacaggttttgttgcagtaggttaacttatgtcccttgaaatgtaattgccaactacactgacaga

SEQ ID NO: 69109 - DNA, 201 bp, Homo sapiens
cttgaactcctgaactcaagtgattcacctgcctcggcctcccaaagtgctgggattacatgcgtcagccactgcacccggcctcagtcttttcttctatrcggcacaaccctggcatgcatagtgcgtacttacacaggttttgttgcagtaggttaacttatgtcccttgaaatgtaattgccaactacactgacagag

SEQ ID NO: 69110 - DNA, 201 bp, Homo sapiens
tcagctgatatgcatattcatgtaaatttttgttgttcttgtcattgtttgagacagagtctcactctgtcgcccaggctggaatgcagtggtacggtctyggatcactgcgacctccacccccgcctctgagttcaagctgttctcctacctcagcctcccaagtagctgggactacatgcatacaccaccatgcctggc

SEQ ID NO: 69111 - DNA, 201 bp, Homo sapiens
tgaggcaggagaatggtgtgaacccgggaggcggagcttgcagtgagctgagattgcgccactgcactccagcctgggcgacagagcgagactccgtctcaaaaaaaaaaaaaaaaagtggaagttgcttttaaaaatactttccatgttagtttgtcttgtgactaacctcatttccatagacactaactacaaaagata

SEQ ID NO: 69112 - DNA, 201 bp, Homo sapiens
aactcaagttcggagtggtacagacatgtatccttttcacggttcctggtgttcgtggacttcagtggtcaccaagattctttcttacatagaaatgggtytaacagtaagcatagtattagaagggccgcttattagctattcagctttaatatttctaatgatcactgaaggacacaaaagaaggactttaataagcaa

SEQ ID NO: 69113 - DNA, 201 bp, Homo sapiens
tggtctcacatctttttctgcacctgcttccctctttgttttccgttgcttcactcaacttagctgtactctctgcctttgttctttggaggggcagtggractgggctggagaagggatctcctccttctgcgcttttctgctgtgcattcacgtactgctggctggtgagcagcctccgtatgtgcagtgggggaggag

SEQ ID NO: 69114 - DNA, 201 bp, Homo sapiens
ttctttaaaaagtgcaagtctggccactttgggaggccaaggcgggcagatcacctaagatcgggagtttgagaccattctgaccagtgtggagaaacccygtctctagtaaaaatacaaaattagccggtaaaaatacaaaattagccgggcgtggtggcgcatgcctgtaatcccagctactcgggcgactgaggcagg

SEQ ID NO: 69115 - DNA, 201 bp, Homo sapiens
tacctcaaaaaaaaaaaagaaaaaaaagtgcaagtcctcccattgcccctcagacctcctgagtcagatcctctggagtggggcccagcagctgtggttcwgcaagccctccaggtgacgctcacgctgctaatgaaggtggccagctctccctcttccgccgcccagattgttgagggtaagccagagaaccaatggatt

SEQ ID NO: 69116 - DNA, 201 bp, Homo sapiens
agccctcgttagctgtttatcccaatcaagctgtgtctggctgtgcactatccaggcctccacattctgtgacaaactaacagggccggctcctgtcactyctgttctcgccagcgggttttaccctgaaggtgactcaggccttctctttgccctagatcgtggggatcatcacacggcacaacctcacctatgaatttc

SEQ ID NO: 69117 - DNA, 201 bp, Homo sapiens
gagctgagcgctgagcatgtgccctgtggaaggacattttagttcagatgccagctggcccaagccctttttggagctaaccttgtccccttggcctccartgtgtgagccctcgttagctgtttatcccaatcaagctgtgtctggctgtgcactatccaggcctccacattctgtgacaaactaacagggccggctcct

SEQ ID NO: 69118 - DNA, 201 bp, Homo sapiens
ttgacacccaggctccctcaccccttctactaaattgtacttacatttgtaatgtgcttgccttcagctgatatgcatattcatgtaaatttttgttgttsttgtcattgtttgagacagagtctcactctgtcgcccaggctggaatgcagtggtacggtcttggatcactgcgacctccacccccgcctctgagttcaa

SEQ ID NO: 69119 - DNA, 201 bp, Homo sapiens
gctggtctcgaactcctgacctcaggtgatactgcttcggtctcccagagtgctgggattacaggtatgagccactatacctggccattttcttctgtttygtaagtatttgttttcttgtacatagttgagaagtttgcaggaattagtataagatactccatattgttctgtcaccttgcactccctcactgaaccctg

SEQ ID NO: 69120 - DNA, 201 bp, Homo sapiens
tacaaaggaatgcatcgggtttgagggagagctggggcagttcagaagagccccccaccccgcccgtggtctgagcagggctggagagccagcacagcttsctcccaggggcctgcgggcactgtcatgaggctggatgacttgccctcctcccccaggctgagagccagcgacatcatggagcccaacctgacctacgtc

SEQ ID NO: 69121 - DNA, 201 bp, Homo sapiens
tagtgtattttatgtgtggccaaagacaattcttcttccagtgtggtccagggaagccaaaagagtagacacccctgtgtcagtagtctttcttggtctcrcatctttttctgcacctgcttccctctttgttttccgttgcttcactcaacttagctgtactctctgcctttgttctttggaggggcagtgggactgggc

SEQ ID NO: 69122 - DNA, 201 bp, Homo sapiens
tgttcgtatgttaccattcagatacctgacaaacacactcttcagttttgggatttggaatttagcttgtggaattagcttttgtcaaaattagcaagctytttgtgtcaacagccagatagtaaatatttaaggctttgtgggccaagaatcagaatggaagctcttatgtagatgtttatgtaactatttacatgtgtg

SEQ ID NO: 69123 - DNA, 201 bp, Homo sapiens
tttaatgcatggggtgggagaggcgaggaagtcaccatcaaaccactttatctacagttagcataagatgtgagaagtgttgacaggaagctgcagcttaratgggatgatcacaactccatggcaacaagatgacacaaatgcagcagagaccccaggggacaggagcctcttgcagtctgtccctaggcccagccctgc

SEQ ID NO: 69124 - DNA, 201 bp, Homo sapiens
tcacgaggaaggtttttgtagccaaggtctcctgacccaggggcgtttctgcactgactgttggtctttcctttttcaccctgcccagggctcttcgtggrgaaggaaggccccatgatccacagtggttcggtggtgggagctggcctccctcaggtaagatgggctgagagggtgtgggcctctgggcaggcctagtgg

SEQ ID NO: 69125 - DNA, 201 bp, Homo sapiens
aaagcaagcttgtccaacccatggcccaacacagattcatataccttttaaaaacatttatgagatttttctgagtttttcttttcttagctcatcagctrtcattagtgtattttatgtgtggccaaagacaattcttcttccagtgtggtccagggaagccaaaagagtagacacccctgtgtcagtagtctttcttgg

SEQ ID NO: 69126 - DNA, 201 bp, Homo sapiens
gtggtacagacatgtatccttttcacggttcctggtgttcgtggacttcagtggtcaccaagattctttcttacatagaaatgggtctaacagtaagcatrgtattagaagggccgcttattagctattcagctttaatatttctaatgatcactgaaggacacaaaagaaggactttaataagcaaagacatatacctat

SEQ ID NO: 69127 - DNA, 201 bp, Homo sapiens
gaggctgaggcaggagaatggcatgaacctgggaggcggagcttgcagtaagccaagatcacgccactgcactccagcctgggtgacagagcaagactccrtctcaaaaacaaacaaacaaaaacatcaatggctgggtgcagtggctcatgcctgtaatctcaggactttgggaggccgaggcaggcagatcacctgagg

SEQ ID NO: 69128 - DNA, 201 bp, Homo sapiens
tcacggaccaccttctttttgtattcctgcaagttcggcacatacccagaaggcaccttgatgtttttactgatgccggggttttctggaaggaagatccrgtgggaacatggtgcagcagtgatcgtgccgatctttgatctgccccctgagctgggggctgagattctgagatcacagaaaacacagaggtcaggggct

SEQ ID NO: 69129 - DNA, 201 bp, Homo sapiens
cccatgcggagctgcctcttcatgccgttggcgtctcaggcagtcagtgacacgtggtctctttgcaggatgtcaccccatacatgaacccttcgcctttyaccgtctcgcccaacacccacgtctcccaagtcttcaacctgttcagaacgatgggcctgcgccacctgcccgtggtgaacgctgtgggagaggtgagcg

SEQ ID NO: 69130 - DNA, 201 bp, Homo sapiens
tgttgcttctctgtaaccacttgaatctctcagatccccattggggcccttgtcttggaggacagcctcttcagtgtccccagttatatgtatatattatwtatatatatatatatatatatatacacacacacactatatatatacacacacacacacacacacacacacacaaacacacattatatatttctgtttgtt

SEQ ID NO: 69131 - DNA, 201 bp, Homo sapiens
tccacaggaaagctcaggacagctgggaaagctgaaggaccagaaccatgtgctgtggggagcagtgcagggtctagcagacatcccttgggtaccaggargaaggagcactggccctgggttcctcctgattccgattcagaatccagggagagggggtatcctgttgcctcacttgggtcatgtgccactccttggctt

SEQ ID NO: 69132 - DNA, 201 bp, Homo sapiens
acctgcccgtggtgaacgctgtgggagaggtgagcgaggccccggccctgcccccacctttgagagaggatcccctagccaggtgctgtttgtgcacccakgcttctcaccagaaacgtaggcatcccaccaggaggggagagtgtggcccaacactagctttgaaccctgctcggcttccgtgcactcgggaccctttcc

SEQ ID NO: 69133 - DNA, 201 bp, Homo sapiens
tgggagaatcgcttgaacccgggagacagaggctgcagtgagccgagatcgcgccattgcactccagcctgggcaatgagagcaaaactgtctcaaaaaamaacaacaaaaaaaaaaaacaaacaaaatcaataaatttgaccacatcaaagtacatattgtatttataaagacaaaaactccaaataacaacaataaaac

SEQ ID NO: 69134 - DNA, 201 bp, Homo sapiens
acttgggtcatgtgccactccttggctttgggggcaggcacgttgattgaaaattctatcaagacaggatgtaggagatggcttgttcccctctggagaawcaagctgctcttcccagattaaaggaaaccacagaagctgcagccaggtcctagggttcaggctcatttgaaccaccagcctgagccactcttttgaacc

SEQ ID NO: 69135 - DNA, 201 bp, Homo sapiens
atcgcttgaacccgggagacagaggctgcagtgagccgagatcgcgccattgcactccagcctgggcaatgagagcaaaactgtctcaaaaaaaaacaacaaaaaaaaaaaacaaacaaaatcaataaatttgaccacatcaaagtacatattgtatttataaagacaaaaactccaaataacaacaataaaacaccataa

SEQ ID NO: 69136 - DNA, 201 bp, Homo sapiens
cagccgagaaggaggacctcctgcagcagatgctggaaaggaggtgagagcctggcggggcccccactgcccgcagggctacacagcggtggggtgagccyttggctcagatgttgtgaggtggctcctgagtttcctgggaaagttggatggggagcgggctgggaacatggatcagaagcgctcccgctgagggtatcc

SEQ ID NO: 69137 - DNA, 201 bp, Homo sapiens
tgatccttcggtcgcagcttgtcaccctgcttgtccgaggagtttgttactctgaaagccagtcggtaagtctctccgaggcagaaatcagccaggccagrcctgacgaagctcgaggggttgggcgctgccggcgggccgtgaacagtgccatagggaaagctgaatgcaaggcgagaagtgcagagtggacttagggga

SEQ ID NO: 69138 - DNA, 201 bp, Homo sapiens
tgtgaacacagcccccatcctcgccactgtcatcacacggcgttctcctgtgtatcttctctcctttccctaaggacgcttgtcaccggatttggggcccrccctaatccagcatgggttcatctgaactcggtcacatctgtagagaccttgtttccagaaaggtcgcattcataggtactagggcttaggacttggcca

SEQ ID NO: 69139 - DNA, 201 bp, Homo sapiens
tacctacaatgacatggccacactcttcttcaacccgcaggagtctgccatcctccagctcttccaccaggatggtgagtgtctgcactgcagcccaatcrtgggtgattggtgtcatctcggacacagccaggcttgcccttcattccaagcaagaccaggacttctttgtaacgcccacccagacaaaagattggtttc

SEQ ID NO: 69140 - DNA, 201 bp, Homo sapiens
attcataggtactagggcttaggacttggccatatcttttggtggggggacacattcaccccccagccactttacttagtgctttctcacttaaacttccwaataagccatttgcatctcatgaatcaggaagaaagggagtgcagacagatcaggggacttgcccagggtgccacagctaggacttggccaaggacttgg

SEQ ID NO: 69141 - DNA, 201 bp, Homo sapiens
gaatatacaagtgccgtgtacaacagtgtggacacttttgaaatacacacaataatttcaggttagtggtttctcccaggggagagaggaaggaaaactgtttttttttttgttttgttttgtttcttaaaatggtactgaatgttttcttttttaaaaatacctggagcatatatggcatgttgttgagatttgttaaag

SEQ ID NO: 69142 - DNA, 201 bp, Homo sapiens
catttgcatctcatgaatcaggaagaaagggagtgcagacagatcaggggacttgcccagggtgccacagctaggacttggccaaggacttggtttgactrgagagctctcactctggagcgcttgctgctgctgcaccacctgcctcagcagcctggagctgggcatattcaggcatcaaggggaggggctctaaggtga

SEQ ID NO: 69143 - DNA, 201 bp, Homo sapiens
cttctctgctgtgtggagctgcttttggacgtttagttgccaatgtcctaaaaaggtactctgtgtgtgtgcgtgtgtgtgcgcatgtgcatgtgtgtgcrcgtgtgcgtgtgtatgcatgtgtgtgcgtgtgcgtgcgttgatgtgtctgtgcccatgcatgcacatatgtgcataggcacaagagtatgagctgtaggt

SEQ ID NO: 69144 - DNA, 201 bp, Homo sapiens
ccagcccaccctctcctggtgctgcctggggaggcaaatcatgctcactccggcgggcacagctggctggggctgttccggggcatggaagattcccagtyacccactcactcagaaagccgggagtcatcggacaccttgctggtcagaggtcctgggggtggttttgaaccatcagagcttggacttttctgacttccc

SEQ ID NO: 69145 - DNA, 201 bp, Homo sapiens
cataggttatatgcaaatatacaccattttatatctgggacttgagcatccctggattttggtatccatcgggatcctggaccctatccctggtgaatackgaggaacaactgtactctttccttgttgcttctctgtaaccacttgaatctctcagatccccattggggcccttgtcttggaggacagcctcttcagtgt

SEQ ID NO: 69146 - DNA, 201 bp, Homo sapiens
gcgggcacagctggctggggctgttccggggcatggaagattcccagtcacccactcactcagaaagccgggagtcatcggacaccttgctggtcagaggycctgggggtggttttgaaccatcagagcttggacttttctgacttccccagcaaggatcttcccacttcctgctccctgtgttcccaccctccagtgttg

SEQ ID NO: 69147 - DNA, 201 bp, Homo sapiens
tccatcgggatcctggaccctatccctggtgaatactgaggaacaactgtactctttccttgttgcttctctgtaaccacttgaatctctcagatccccaytggggcccttgtcttggaggacagcctcttcagtgtccccagttatatgtatatattatatatatatatatatatatatatatacacacacacactatat

SEQ ID NO: 69148 - DNA, 201 bp, Homo sapiens
ggagatgccagtgacaacatacagttcatgactaggtttaggaattgggcactgagaaaattctcaatatttcagagagtccttcccttatttgggactcytaacacggtatcctcgctagttggttttaagggaaacactctgctcctgggtgtgagcagaggctctggtcttgccctgtggtttgactctccttagaac

SEQ ID NO: 69149 - DNA, 201 bp, Homo sapiens
cttgttgcttctctgtaaccacttgaatctctcagatccccattggggcccttgtcttggaggacagcctcttcagtgtccccagttatatgtatatattatatatatatatatatatatatatatacacacacacactatatatatacacacacacacacacacacacacacacaaacacacattatatatttctgtttg

SEQ ID NO: 69150 - DNA, 201 bp, Homo sapiens
aatggacaagtaaggccatgattttgctcatgtcctagtttcagaatgtataagctctgaggcctaaggaatgttgttattagggtaggaaacagtaactyacttttcttgggctgaaagaagcaacacacccattcctgagcatgtgtgagaatgtggagcagcccatgggctgggggctgcgggggcagggcaggggac

SEQ ID NO: 69151 - DNA, 201 bp, Homo sapiens
ggcccttgtcttggaggacagcctcttcagtgtccccagttatatgtatatattatatatatatatatatatatatatatacacacacacactatatatayacacacacacacacacacacacacacacaaacacacattatatatttctgtttgttttgtttttttaagacggagtcttactctgttacccaggccggag

SEQ ID NO: 69152 - DNA, 201 bp, Homo sapiens
ctgtaacagccctgcaagacacagataacattttatttttttaaaaagttgttagtcccctaaaccaaagagcaacatatactgcagaaataaaaagttartcatagcaaaggagaagtaacagtatctggttttaataatagctcatatattccattggtacatatttacaaagggccaaactcaactaatttatttaaa

SEQ ID NO: 69153 - DNA, 201 bp, Homo sapiens
gaggtgtcctgaagaggagggtggttatttggagactatcagtggaaatgaagagctcagctgatggctgtagatcctcacccacatggtccctcaccccygaaaggttttttttgagggctggttcctatttgataatggctccagatgatttagaagctagccactgatttcagtaaatacttctgcctccttccactc

SEQ ID NO: 69154 - DNA, 201 bp, Homo sapiens
tgcgatctcggctcaccacaacctccacctcccaggttccagtgattctcctgcctcagcctccaaagtagctgggactacaggtgcgcgccaccatgccyggctaattttgtatttttagtagagacagggtttcaccatgttggctagactggtcttgaactcctgacctcaggtgatccacctgccttgacctcccaa

SEQ ID NO: 69155 - DNA, 201 bp, Homo sapiens
aaatccttaagctccatcagtactgctgtgttcgtttgcccatgcgcagtagcctgtggcctccccacccacagaaatccagcatcctcacccgggctggygagcagcgcaaacggagccagtccatgaagtcctacccatccagcgagctacggaacatgtgtgatgagcacatcgcctctgaggagccagccgagaagg

SEQ ID NO: 69156 - DNA, 201 bp, Homo sapiens
tcacttttatatgcactgggtaaccaaaacactcgtgtgactcactttattgtgatatttgctttattgtggtggtctagaaccaaacccatgctatctgyaaggtaggcctatgttggcatttattccctaggcctttatcctgccaaccagagttccccctgtcagtgcaccttgcccagcctcttaagagtccatcat

SEQ ID NO: 69157 - DNA, 201 bp, Homo sapiens
cattttttaaaatataaaaaagcacaccatttgtgctatgagaatttcagacaacacccagaaacaaatatctccttaagcactacctcacggatgttttyccattatgaatgctgacgtacaaataatcctaattttgtttaatcaaaaagggatattatacttttaattctccatcctgctttatttttattttttaat

SEQ ID NO: 69158 - DNA, 201 bp, Homo sapiens
aaagcacaccatttgtgctatgagaatttcagacaacacccagaaacaaatatctccttaagcactacctcacggatgttttcccattatgaatgctgacktacaaataatcctaattttgtttaatcaaaaagggatattatacttttaattctccatcctgctttatttttattttttaattgcatcttgctcttttgc

SEQ ID NO: 69159 - DNA, 201 bp, Homo sapiens
caaataacaacaataaaacaccataaataaagtgaaaacaagtccacagcctgagagaggttatttactatgcatttaagaggcagataattagtatccasaatacaggaagaggctgggcgcggtggctgacgcctgtaatcccagcactttgggaggccgaggcaggcggatcacttgaggtcaggagttcaagaccag

SEQ ID NO: 69160 - DNA, 201 bp, Homo sapiens
gaaattatttttctttaaaaagtgcaagtctggccactttgggaggccaaggcgggcagatcacctaagatcgggagtttgagaccattctgaccagtgtrgagaaaccccgtctctagtaaaaatacaaaattagccggtaaaaatacaaaattagccgggcgtggtggcgcatgcctgtaatcccagctactcgggcga

SEQ ID NO: 69161 - DNA, 201 bp, Homo sapiens
ttccagctccaggtaaccccagtgcacctgctacctttatcccataccacgaggaagaatccagaaatgtatgaccttcctctgttgagaactaatagatrtgttgggttcatccttccacacccattacctgagcgttgagagatatgggaatctgtagtcgtctttttacctcagagaaagtgcacaccacatgccctg

SEQ ID NO: 69162 - DNA, 201 bp, Homo sapiens
gttctcattgtaaccctaacatgtgagaataaaatgtcttctgtctcctctgtctcctttagccttttgtctccatgctgctttctttctttctttctttytttgagacagagtctcgctgtcacccaggctggagtgcagtggtgccatctcagctcactgcaagctccgcctcccaggttcacgccattctcctgcctc

SEQ ID NO: 69163 - DNA, 201 bp, Homo sapiens
accagagaaaatctaattaatactctcattttctgaatgttcccccctaaaaacaacaaaaaccccactaggagtggaatttgaggcctccccaaccaccyaccaaaaaaggagggtgaaatgaaaggaagaagaaaaactcagcattctttcctctgacaaagagtaaaacgacaaggaatatcggcctgaattctcttc

SEQ ID NO: 69164 - DNA, 201 bp, Homo sapiens
ggtaccttgttcagtctagaggagggttcgtccttctggaaccaagggctcacgtggaaagtggtgaggaggaccttcagtgaaagcattaaccacacccmccgaattacactgggtgtcccttactcggtacatggaatggtagttttgatgagactgggggggtcaactggatcagaaacagctttcctcttgtgccca

SEQ ID NO: 69165 - DNA, 201 bp, Homo sapiens
gttcatgactaggtttaggaattgggcactgagaaaattctcaatatttcagagagtccttcccttatttgggactcttaacacggtatcctcgctagttkgttttaagggaaacactctgctcctgggtgtgagcagaggctctggtcttgccctgtggtttgactctccttagaaccaccgcccaccagaaacataaag

SEQ ID NO: 69166 - DNA, 201 bp, Homo sapiens
gcccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagt

SEQ ID NO: 69167 - DNA, 201 bp, Homo sapiens
ttcttctccaggctggcccgccccctctgactaggcacccaaagtgagcatctgggcattgggcattcatgcttatcttcccccaccttctacatggtatyagtcccagcaggcatccctggggcagacgtgctttggctcaagatggccttcatttacgtttagttttttttaaaaccgtggaggttgcccacgggcctc

SEQ ID NO: 69168 - DNA, 201 bp, Homo sapiens
cccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtg

SEQ ID NO: 69169 - DNA, 201 bp, Homo sapiens
gtgacaggaaagcctttcgagaggcccaaggtggcctcgccagccctgcagtattgatgtgcagtattgcaccacagctctgcggaccttggccattgccrcagtcgcagcttccttttttctgtttgcactgtttgtttgtatgatgttagctaattccactgtgtatataaattgtattttttttaatttgtaaaatgc

SEQ ID NO: 69170 - DNA, 201 bp, Homo sapiens
aacttcttaaagcccaatctagagttggtcatacctggggtgtatctactgtaagggtgactagatctctgtacccggatgtagattccggaggtctctgygtagagcagtgggtaccaggaggaagggttgggagagagtaggacatgccactcctgaaccttcttgtcttttgtcacctctcccctagctcttttgttc

SEQ ID NO: 69171 - DNA, 201 bp, Homo sapiens
ctctagaattcatctcctcctgctagcagccgcgtcctggaggagcagcggatggggaatccattctgtttcttcctggtgtttaggaagttgccccacamacagattgccccgatgtccaaccagaagaagtgaaactgctgctgggtctggagaggtgaagacccgtggccagcttctgttgttgccatcggccattgc

SEQ ID NO: 69172 - DNA, 201 bp, Homo sapiens
ccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtgc

SEQ ID NO: 69173 - DNA, 201 bp, Homo sapiens
agggcagatcgatcagaggagtcccaggggccccgcccgagggcacctccatctctctgggctgggctgacttccccggtccagggaggcacctcagggarggggctgagagcagcccccgcttcttcattcggctcactgagcacttgtgggggcacgacctcatcttctaaaggcatcttttcttccaaatggtccagc

SEQ ID NO: 69174 - DNA, 201 bp, Homo sapiens
cggccattgctttttgttcgcttgcttttggttttgcaagaagagcggcctctgtctctgatctgcttcaaatcatcattccatcagtgacagaagtggcygttccatcagtggtcgcagccagttcagctcctgcatccatccccaagtgttctgtaagtcccaggggcattttctgccttgtgtttttgtcatttttca

SEQ ID NO: 69175 - DNA, 201 bp, Homo sapiens
cttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtgca

SEQ ID NO: 69176 - DNA, 201 bp, Homo sapiens
tgtcttggaggacagcctcttcagtgtccccagttatatgtatatattatatatatatatatatatatatatatacacacacacactatatatatacacayacacacacacacacacacacacaaacacacattatatatttctgtttgttttgtttttttaagacggagtcttactctgttacccaggccggagtgcagt

SEQ ID NO: 69177 - DNA, 201 bp, Homo sapiens
cagtggtcgcagccagttcagctcctgcatccatccccaagtgttctgtaagtcccaggggcattttctgccttgtgtttttgtcatttttcaatcagttycattcaatgagaactccctgtgttacctgtgttacggtgacaccttgagaatgggctacttcccctcctagcaacccgcaacaccatcccagacctcagg

SEQ ID NO: 69178 - DNA, 201 bp, Homo sapiens
caagtgatccacccatctcggcctcccaaattgctaggattacaggtgtgtcaccacgcccagcctggtttatatatatatgtttttgtttttgtttttgytttttttttggcaaagtctcactctgttgcccaagctggagtggagtggcaagatctcggctcactgcaaactccacctcctgggttcaagcgattctcc

SEQ ID NO: 69179 - DNA, 201 bp, Homo sapiens
cgcaaggagcaagttactacttcatttcctcttttcccaatttctggacaagaccaaggcaatttgaccaacatttatggggcatcaactctgagagtgcygaaggggcatttgccctcaaagagcttgcagtctagggacgtagacacaagcaattgcacataggcaactcgtgttgtgtgctattataacagttacatg

SEQ ID NO: 69180 - DNA, 201 bp, Homo sapiens
tgctggaacggaaacttcttaaagcccaatctagagttggtcatacctggggtgtatctactgtaagggtgactagatctctgtacccggatgtagattcyggaggtctctgcgtagagcagtgggtaccaggaggaagggttgggagagagtaggacatgccactcctgaaccttcttgtcttttgtcacctctccccta

SEQ ID NO: 69181 - DNA, 201 bp, Homo sapiens
tatgaatattttaatttcccagtgctagtggcagttgcttttttttttttttttttttgagacggagtcttgctctgtcgcccaggctggagtgcagtggygccatctctgctcactgcaagctccgcctcccgggttcacgccattctcctgcctcagcctccggagtagctaggacttacaggcgcctgccaccacgcc

SEQ ID NO: 69182 - DNA, 201 bp, Homo sapiens
aatggctccagatgatttagaagctagccactgatttcagtaaatacttctgcctccttccactcctaaccactaaaaaaggctccctctgcggatctgtktttctagaccatccttggagaaacacaggaggaggaggatgagattcttccaaggaaagactatgaggtgagctcctttgatactgcttgggcaactaaa

SEQ ID NO: 69183 - DNA, 201 bp, Homo sapiens
ctaattttttgtatttttagtagagacggggtttcaccgtgttagccaggatggtctccatctcctgacctcgtgatccacccgccttggcctcccaaagygctgggattacaggcgtgagccaccgcgcctggcctttttttttttttttttttttttttgagacagtctcgctctatcacctaggctggactgcagtgg

SEQ ID NO: 69184 - DNA, 201 bp, Homo sapiens
ggggtttcaccgtgttagccaggatggtctccatctcctgacctcgtgatccacccgccttggcctcccaaagtgctgggattacaggcgtgagccaccgygcctggcctttttttttttttttttttttttttgagacagtctcgctctatcacctaggctggactgcagtggcgcgatctctgctcactgcaacctctg

SEQ ID NO: 69185 - DNA, 201 bp, Homo sapiens
ctgtgtggagctgcttttggacgtttagttgccaatgtcctaaaaaggtactctgtgtgtgtgcgtgtgtgtgcgcatgtgcatgtgtgtgcacgtgtgcrtgtgtatgcatgtgtgtgcgtgtgcgtgcgttgatgtgtctgtgcccatgcatgcacatatgtgcataggcacaagagtatgagctgtaggtcctcccca

SEQ ID NO: 69186 - DNA, 201 bp, Homo sapiens
tgggattacaggcgtgagccaccgcgcctggcctttttttttttttttttttttttttgagacagtctcgctctatcacctaggctggactgcagtggcgygatctctgctcactgcaacctctgcctcctgggttcaagtgattctcctgcctcagcctcccaagtagctgagagtacaggtgcccgccaccacacccag

SEQ ID NO: 69187 - DNA, 201 bp, Homo sapiens
tccaggatccctgcctattcattcacaggtgtgagaaaatgttcatgataaggaagtcagaaaccaccttttgggggctgggggctctttattggataacycgtctctctcctctcctcagagacaagagagactttgtatcagcaggagcggctgctggagttgctgcagctttcggggcgccaatcgggggtaccttgt

SEQ ID NO: 69188 - DNA, 201 bp, Homo sapiens
gcacacatgttgactgaccaggggctgctgtgaatgctgtttggagaaatcggggctgggggtaggcagggttatgttttgaatttctgagaccagagctkctttctgtggcgttgtaacagctgtgctttgcctcctagagtcttagagagcctccttgtgtctctggtaaccaccgtggtggtgtttgtggcctcgatg

SEQ ID NO: 69189 - DNA, 201 bp, Homo sapiens
ccaagcaagaccaggacttctttgtaacgcccacccagacaaaagattggtttctgcctcctgtgttggaaggggaactggtatggggtgtggtcgggccyggtaggtctactgggccttggcaggcatccggtagtgggactcaggttggctcttcccttgcaggtactttcagccccgtcactctggccttgttcttcg

SEQ ID NO: 69190 - DNA, 201 bp, Homo sapiens
caaaccactttatctacagttagcataagatgtgagaagtgttgacaggaagctgcagcttagatgggatgatcacaactccatggcaacaagatgacacraatgcagcagagaccccaggggacaggagcctcttgcagtctgtccctaggcccagccctgcttgtcctccctggctgttatcttcggtactgcaaagag

SEQ ID NO: 69191 - DNA, 201 bp, Homo sapiens
tacagttagcataagatgtgagaagtgttgacaggaagctgcagcttagatgggatgatcacaactccatggcaacaagatgacacaaatgcagcagagamcccaggggacaggagcctcttgcagtctgtccctaggcccagccctgcttgtcctccctggctgttatcttcggtactgcaaagagaacacagacatatc

SEQ ID NO: 69192 - DNA, 201 bp, Homo sapiens
aacaagatgacacaaatgcagcagagaccccaggggacaggagcctcttgcagtctgtccctaggcccagccctgcttgtcctccctggctgttatcttcrgtactgcaaagagaacacagacatatctggcttggtgacctggctgtcctggaaaagtcagcttcatgtatgagtgtgcccatcctctgaacttgattac

SEQ ID NO: 69193 - DNA, 201 bp, Homo sapiens
ggaggaccttcagtgaaagcattaaccacaccccccgaattacactgggtgtcccttactcggtacatggaatggtagttttgatgagactgggggggtcractggatcagaaacagctttcctcttgtgcccataacctccacactggactttctgtacttctcatatcaataccctccctaaccccaaatcaaaccgct

SEQ ID NO: 69194 - DNA, 201 bp, Homo sapiens
cccatttccatccccagttcctcttacccggaagctgttacagcccagtccgctctgggctccaatcctgtccatcctgcccccgaagcagctggatctcygcaggctccgaggggcagtgagcagcgccctcagcttgctttttaggagggcagatcgatcagaggagtcccaggggccccgcccgagggcacctccatc

SEQ ID NO: 69195 - DNA, 201 bp, Homo sapiens
ttccagccagagccgcgcctctaccaggctgtgtcttcctcctgaaatgttgctcttcactccgtaccactggtgttccttggttctccacctgcgtaggkatttgcgcattagatgagagaatttcaagcaaaatactttgagttttacaaagatataaaacacctagtaattattgctgcagactttccttttttcttc

SEQ ID NO: 69196 - DNA, 201 bp, Homo sapiens
ggactgcagtggcgcgatctctgctcactgcaacctctgcctcctgggttcaagtgattctcctgcctcagcctcccaagtagctgagagtacaggtgccygccaccacacccagctaatttttgtatttttagtagagctggggtttcaccatgttggccaggatagtcttgatctcttgacctcatgatccgcctgcct

SEQ ID NO: 69197 - DNA, 201 bp, Homo sapiens
tgagagaggatcccctagccaggtgctgtttgtgcacccaggcttctcaccagaaacgtaggcatcccaccaggaggggagagtgtggcccaacactagckttgaaccctgctcggcttccgtgcactcgggaccctttcccctgcctgccagcagatggcaccagcgtcccactggccgtcctttccagccagagccgcg

SEQ ID NO: 69198 - DNA, 201 bp, Homo sapiens
caggtgcccgccaccacacccagctaatttttgtatttttagtagagctggggtttcaccatgttggccaggatagtcttgatctcttgacctcatgatcsgcctgcctcggcctcccaaagtgctgggattacaggcgtgagccaccgtgcccagcccccccccttttttttttaagcattttctcagcagactagctaa

SEQ ID NO: 69199 - DNA, 201 bp, Homo sapiens
ctggggtttcaccatgttggccaggatagtcttgatctcttgacctcatgatccgcctgcctcggcctcccaaagtgctgggattacaggcgtgagccacygtgcccagcccccccccttttttttttaagcattttctcagcagactagctaaggacaatagatggcatgtcctgacacccatggggcactctgggtgtt

SEQ ID NO: 69200 - DNA, 201 bp, Homo sapiens
tcaagtgatcctcctgcctcagcctcccaaagtgttgggattacaggcatgagccattgcacccagtcatctcaggcagtttttaaaaaatttttatatakagagaaaaagtgcactcagcagccagcatgatccaaaggagaagcagctgcaccctctcaagtgatgacggggacacccctcggctgatgaacaagtttc

SEQ ID NO: 69201 - DNA, 201 bp, Homo sapiens
tgcctgctctccacgtggaatttagcttaaaactggttggccaagatgtatttcttcccctctgccaccataaccctgtaaactgaatcattcttttcctrtgtgaacagaaaggtcgaagatatgaggcggtgaagtggatggtggtgtttgccattggagtctgcactggcctggtgaggaggcagggcctggagggat

SEQ ID NO: 69202 - DNA, 201 bp, Homo sapiens
aactggttggccaagatgtatttcttcccctctgccaccataaccctgtaaactgaatcattcttttcctgtgtgaacagaaaggtcgaagatatgaggcrgtgaagtggatggtggtgtttgccattggagtctgcactggcctggtgaggaggcagggcctggagggatggtgggccatagggctggaggggcttacag

SEQ ID NO: 69203 - DNA, 201 bp, Homo sapiens
gatagtcagtcaactagaaaacccttctgttgaatatctttctaaaaagtgccccttcttcctgtctcaggaagagttcattgcacatatttgactctttrtttgataaatttagggtcttacaaaatgttagaatcccattttgacatccattctcattataggtggtttgaaaaatggtaactttctgtgagatgtgcc

SEQ ID NO: 69204 - DNA, 201 bp, Homo sapiens
tctttcctttttcaccctgcccagggctcttcgtggggaaggaaggccccatgatccacagtggttcggtggtgggagctggcctccctcaggtaagatgrgctgagagggtgtgggcctctgggcaggcctagtgggaggtctggttacactgggccaaatccattgggacaccctgacatcacattggaacctggtgcc

SEQ ID NO: 69205 - DNA, 201 bp, Homo sapiens
ttggtgtcatctcggacacagccaggcttgcccttcattccaagcaagaccaggacttctttgtaacgcccacccagacaaaagattggtttctgcctccwgtgttggaaggggaactggtatggggtgtggtcgggcccggtaggtctactgggccttggcaggcatccggtagtgggactcaggttggctcttcccttg

SEQ ID NO: 69206 - DNA, 201 bp, Homo sapiens
tcctctgacaaagagtaaaacgacaaggaatatcggcctgaattctcttcccaagaagaaagaaagcacaccaacgcaggcatttgtcttctgtccatggkgctgaagtttattcactttcaaaccactttcagtaacaggtgaggttctaccttaaaatttaatgcatggggtgggagaggcgaggaagtcaccatcaaa

SEQ ID NO: 69207 - DNA, 201 bp, Homo sapiens
tcaccatcaaaccactttatctacagttagcataagatgtgagaagtgttgacaggaagctgcagcttagatgggatgatcacaactccatggcaacaagrtgacacaaatgcagcagagaccccaggggacaggagcctcttgcagtctgtccctaggcccagccctgcttgtcctccctggctgttatcttcggtactg

SEQ ID NO: 69208 - DNA, 201 bp, Homo sapiens
tttgtatttttagtagagacgaggcttctccatgttggtcaggctggtcttgaactcctggcctcgggtgatccgcccgccttggcctcccaaagtgctgrgattacagacgtgagccactgcgcccagctaattcctacagtcaattttagaatattttcatcacctgagaggaaaccctgcactcattagcagccactg

SEQ ID NO: 69209 - DNA, 201 bp, Homo sapiens
ccaggatagtcttgatctcttgacctcatgatccgcctgcctcggcctcccaaagtgctgggattacaggcgtgagccaccgtgcccagcccccccccttytttttttaagcattttctcagcagactagctaaggacaatagatggcatgtcctgacacccatggggcactctgggtgttggggcagaaacttgagaggg

SEQ ID NO: 69210 - DNA, 201 bp, Homo sapiens
gctgcaggtggtgctgctgctgcggtgagcgtgagacccgcacccccgaggagctggtaagaagccggcggagtcggcctggggagggggcggttgctaarggactgagagaggcgttgccgggggtggggccgggccaatctgggcccgcaggtggcagcgggtggggcctggggaccgcagccagggctctcgaagcgt

SEQ ID NO: 69211 - DNA, 201 bp, Homo sapiens
aagctgtgtctggctgtgcactatccaggcctccacattctgtgacaaactaacagggccggctcctgtcactcctgttctcgccagcgggttttaccctkaaggtgactcaggccttctctttgccctagatcgtggggatcatcacacggcacaacctcacctatgaatttctgcaggcccggctgaggcagcactacc

SEQ ID NO: 69212 - DNA, 201 bp, Homo sapiens
ttcagaagagccccccaccccgcccgtggtctgagcagggctggagagccagcacagcttgctcccaggggcctgcgggcactgtcatgaggctggatgayttgccctcctcccccaggctgagagccagcgacatcatggagcccaacctgacctacgtctacccgcacacccgcatccagtctctggtgagcatcctgc

SEQ ID NO: 69213 - DNA, 201 bp, Homo sapiens
atgcaaggcgagaagtgcagagtggacttaggggaggagtcgccacagccgggtggtgagaagcaacagcggtttattccttcatagttcaaggccagaartacaaaatccgggtgtcaccagggcagcgctccctggctctggtgctgtccttgccccttcctagctcatgggagttgcctgcagaccttggtgctcctg

SEQ ID NO: 69214 - DNA, 201 bp, Homo sapiens
agcatgtgtcgggggatagaagtacaaaggaatgcatcgggtttgagggagagctggggcagttcagaagagccccccaccccgcccgtggtctgagcagrgctggagagccagcacagcttgctcccaggggcctgcgggcactgtcatgaggctggatgacttgccctcctcccccaggctgagagccagcgacatcat

SEQ ID NO: 69215 - DNA, 201 bp, Homo sapiens
cctaataagccatttgcatctcatgaatcaggaagaaagggagtgcagacagatcaggggacttgcccagggtgccacagctaggacttggccaaggactyggtttgactggagagctctcactctggagcgcttgctgctgctgcaccacctgcctcagcagcctggagctgggcatattcaggcatcaaggggaggggc

SEQ ID NO: 69216 - DNA, 201 bp, Homo sapiens
tgtgtgtgcgtgtgcgtgcgttgatgtgtctgtgcccatgcatgcacatatgtgcataggcacaagagtatgagctgtaggtcctccccacagcctatcartgtggttcaaagccatgttctcggtgttttccttcactagctacattggattgggccacatctattcggggacctttgccctgattggtgcagcggcttt

SEQ ID NO: 69217 - DNA, 201 bp, Homo sapiens
caccattttatatctgggacttgagcatccctggattttggtatccatcgggatcctggaccctatccctggtgaatactgaggaacaactgtactctttycttgttgcttctctgtaaccacttgaatctctcagatccccattggggcccttgtcttggaggacagcctcttcagtgtccccagttatatgtatatatt

SEQ ID NO: 69218 - DNA, 201 bp, Homo sapiens
tgctacacttggaaataaggctgtgtgacagatctcttgctcttcacaggtgggtctctttgtggacttttttgtgcgactcttcacccaactcaagttcrgagtggtacagacatgtatccttttcacggttcctggtgttcgtggacttcagtggtcaccaagattctttcttacatagaaatgggtctaacagtaagc

SEQ ID NO: 69219 - DNA, 201 bp, Homo sapiens
gcatttcagataagtgttactcaagctgaagcaactttacctcctacctttgtattttaggaaggcacacctgcctttatgacatagcactcccaactctygtccattgatgtgtggccactttatggcttcagtatcaaaaagcctccaggcattggcttgagggaaggccagagttaaaggcaagaagctttgatcctg

SEQ ID NO: 69220 - DNA, 201 bp, Homo sapiens
gactgaggcaggggaattgctggaacccagaaggcggaggttgcaatgagtggagattgtgccattgcactccagcctgggcaacaagagtgaaactctayctcaaaaaaaaaaaagaaaaaaaagtgcaagtcctcccattgcccctcagacctcctgagtcagatcctctggagtggggcccagcagctgtggttctgc

SEQ ID NO: 69221 - DNA, 201 bp, Homo sapiens
gttccccagatggggtctagaaggagaggcagcctggaggactgggtctgctctccaggcattatggaggtgggttttcttttgcagcaaattcaggtgctttttttttttttgtagcaaattgcagcaaaatcaaaggctttttctatttggaaccagagttggggctttcggtcaagtggtgccctggattttcctccc

SEQ ID NO: 69222 - DNA, 201 bp, Homo sapiens
tcatggagcccaacctgacctacgtctacccgcacacccgcatccagtctctggtgagcatcctgcgcaccacggtccaccatgccttcccggtggtcacrgagaaccgcggtaacgagaaggagttcatgaagggcaaccagctcatcagcaacaacatcaagttcaaggtaaagaaaacggcatgagaggaaaggcagg

SEQ ID NO: 69223 - DNA, 201 bp, Homo sapiens
ggcgccaatcgggggtaccttgttcagtctagaggagggttcgtccttctggaaccaagggctcacgtggaaagtggtgaggaggaccttcagtgaaagcrttaaccacaccccccgaattacactgggtgtcccttactcggtacatggaatggtagttttgatgagactgggggggtcaactggatcagaaacagcttt

SEQ ID NO: 69224 - DNA, 201 bp, Homo sapiens
ttaactgtccactttttacaaacaaattgctggaatacagcaaatcacggatcaattctgcacacatgttgactgaccaggggctgctgtgaatgctgttyggagaaatcggggctgggggtaggcagggttatgttttgaatttctgagaccagagcttctttctgtggcgttgtaacagctgtgctttgcctcctagag

SEQ ID NO: 69225 - DNA, 201 bp, Homo sapiens
acctcctgcagcagatgctggaaaggaggtgagagcctggcggggcccccactgcccgcagggctacacagcggtggggtgagcctttggctcagatgttktgaggtggctcctgagtttcctgggaaagttggatggggagcgggctgggaacatggatcagaagcgctcccgctgagggtatcccaggcagcatctggt

SEQ ID NO: 69226 - DNA, 201 bp, Homo sapiens
ctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctcca

SEQ ID NO: 69227 - DNA, 201 bp, Homo sapiens
gaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccacc

SEQ ID NO: 69228 - DNA, 201 bp, Homo sapiens
agtggtgaggaggaccttcagtgaaagcattaaccacaccccccgaattacactgggtgtcccttactcggtacatggaatggtagttttgatgagactgrgggggtcaactggatcagaaacagctttcctcttgtgcccataacctccacactggactttctgtacttctcatatcaataccctccctaaccccaaatc

SEQ ID NO: 69229 - DNA, 201 bp, Homo sapiens
gagatgccagcaacagaaatggacttcgacctccttaagaaagagaaagaaatccacaggaaagctcaggacagctgggaaagctgaaggaccagaaccaygtgctgtggggagcagtgcagggtctagcagacatcccttgggtaccaggaggaaggagcactggccctgggttcctcctgattccgattcagaatccag

SEQ ID NO: 69230 - DNA, 201 bp, Homo sapiens
tggagaagggatctcctccttctgcgcttttctgctgtgcattcacgtactgctggctggtgagcagcctccgtatgtgcagtgggggaggagatgccttyaagaggagcacacctgtactatacttgtgctacacttggaaataaggctgtgtgacagatctcttgctcttcacaggtgggtctctttgtggactttttt

SEQ ID NO: 69231 - DNA, 201 bp, Homo sapiens
ttgtcctttccccaaggatttttaatttgacccatgaaaatttcctctcaagtgaaggaccagagagaaatgagcagagggctaggtacaacttccagggrcacatctcacccattagcctctgccgtgcgggaaagcagccccactcttgcttctgtcttctcttctgtctcttccggttctcatggctgctatggtttt

SEQ ID NO: 69232 - DNA, 201 bp, Homo sapiens
attaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacaga

SEQ ID NO: 69233 - DNA, 201 bp, Homo sapiens
agaaggaacaggagctctgcttgtcaagtctcctcccctccctatccgctactatttactgcatgcagtagataactggtgacatggactgagcacatttraggtgttcattccgtgggcatcagcagaccctcagaggtgcattagctaactatagaacctcctcttaatttctctataaagggggctgtttgccacact

SEQ ID NO: 69234 - DNA, 201 bp, Homo sapiens
cagagcaagtgtttgcactgcgtctgcaggacaaaaagctcccaccgctgctctctgagatctgggatgtgcacgaatgactgttctgtccccatattttytgttttcttggccggatggctgaggcctggtggctgcctcctagaagtggaacagactgagaagggcaaacattcctgggagctgggcaaggagatcctc

SEQ ID NO: 69235 - DNA, 201 bp, Homo sapiens
ttaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagag

SEQ ID NO: 69236 - DNA, 201 bp, Homo sapiens
agtgtttgcactgcgtctgcaggacaaaaagctcccaccgctgctctctgagatctgggatgtgcacgaatgactgttctgtccccatattttctgttttyttggccggatggctgaggcctggtggctgcctcctagaagtggaacagactgagaagggcaaacattcctgggagctgggcaaggagatcctcccgtggc

SEQ ID NO: 69237 - DNA, 201 bp, Homo sapiens
taggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagc

SEQ ID NO: 69238 - DNA, 201 bp, Homo sapiens
tgggagctgggcaaggagatcctcccgtggcattaaaagagagtcaaagggttgcgagttttgtggctactgagcagtggagccctcgctaacactgtgcygtgtctgaagatcatgctgaccccacaaacggatgggcctgggggccactttgcacagggttctccagagccctgcccatcctgcctccaccacttcctg

SEQ ID NO: 69239 - DNA, 201 bp, Homo sapiens
ggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagcca

SEQ ID NO: 69240 - DNA, 201 bp, Homo sapiens
gaaactccctggaaggcccagcacctgcctctctccacccctggatttctaccagcttggctgaggcctggggctagtggggagagcttcttggcctcttyccagaggcaagggaggaggagggaggctgggaaagccgctggggctcagtgtcgcaattccgggccgtgctgggacctttgctccacgaggtgcctatgg

SEQ ID NO: 69241 - DNA, 201 bp, Homo sapiens
gtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccac

SEQ ID NO: 69242 - DNA, 201 bp, Homo sapiens
ccgctgctctctgagatctgggatgtgcacgaatgactgttctgtccccatattttctgttttcttggccggatggctgaggcctggtggctgcctcctaraagtggaacagactgagaagggcaaacattcctgggagctgggcaaggagatcctcccgtggcattaaaagagagtcaaagggttgcgagttttgtggct

SEQ ID NO: 69243 - DNA, 201 bp, Homo sapiens
caccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacagg

SEQ ID NO: 69244 - DNA, 201 bp, Homo sapiens
caccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggccc

SEQ ID NO: 69245 - DNA, 201 bp, Homo sapiens
gaattttgtctctaggcctttctgagcctcactttccttgtttataaaatggaaataaaaattatggttgtcataaggatcagtgcatataaaaggctcayacagtacctagaacataatggcacttggcaaatgagggctactcttctcataaaagagagactggagtttgtataatgaagggaatgaaggtcactgagt

SEQ ID NO: 69246 - DNA, 201 bp, Homo sapiens
accatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggccca

SEQ ID NO: 69247 - DNA, 201 bp, Homo sapiens
ccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaa

SEQ ID NO: 69248 - DNA, 201 bp, Homo sapiens
catgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaat

SEQ ID NO: 69249 - DNA, 201 bp, Homo sapiens
ggaagacctacagctgaaagaactgggagggtgatgataactcgtgccatttctcaaacactatgtgccacacgttgtgatagactctctttctttctttytttttctttctttctttctttctttctttctttctttctttctttctttctctctctctctctctctctctctttctttctttctttctttctttctttc

SEQ ID NO: 69250 - DNA, 201 bp, Homo sapiens
gaagacctacagctgaaagaactgggagggtgatgataactcgtgccatttctcaaacactatgtgccacacgttgtgatagactctctttctttctttctttttctttctttctttctttctttctttctttctttctttctttctttctctctctctctctctctctctctttctttctttctttctttctttctttct

SEQ ID NO: 69251 - DNA, 201 bp, Homo sapiens
aagacctacagctgaaagaactgggagggtgatgataactcgtgccatttctcaaacactatgtgccacacgttgtgatagactctctttctttctttctytttctttctttctttctttctttctttctttctttctttctttctttctctctctctctctctctctctctttctttctttctttctttctttctttctc

SEQ ID NO: 69252 - DNA, 201 bp, Homo sapiens
atttctcaaacactatgtgccacacgttgtgatagactctctttctttctttctttttctttctttctttctttctttctttctttctttctttctttctttctctctctctctctctctctctctttctttctttctttctttctttctttctctttctctctctctctctctttctttcttctttttttttggagtttt

SEQ ID NO: 69253 - DNA, 201 bp, Homo sapiens
tttctcaaacactatgtgccacacgttgtgatagactctctttctttctttctttttctttctttctttctttctttctttctttctttctttctttctttctctctctctctctctctctctctttctttctttctttctttctttctttctctttctctctctctctctctttctttcttctttttttttggagttttg

SEQ ID NO: 69254 - DNA, 201 bp, Homo sapiens
ttctcaaacactatgtgccacacgttgtgatagactctctttctttctttctttttctttctttctttctttctttctttctttctttctttctttctttytctctctctctctctctctctctttctttctttctttctttctttctttctctttctctctctctctctctttctttcttctttttttttggagttttgc

SEQ ID NO: 69255 - DNA, 201 bp, Homo sapiens
tctcaaacactatgtgccacacgttgtgatagactctctttctttctttctttttctttctttctttctttctttctttctttctttctttctttctttctctctctctctctctctctctctttctttctttctttctttctttctttctctttctctctctctctctctttctttcttctttttttttggagttttgct

SEQ ID NO: 69256 - DNA, 201 bp, Homo sapiens
tgtattcctttggcacttgtagactcatgctatctgaatctgcacctattcatagatttatttatacaagcagttttgaagtaatcatgcttgcatttctyatttcatgagtgaggtcttggggagaaggaacaggagctctgcttgtcaagtctcctcccctccctatccgctactatttactgcatgcagtagataact

SEQ ID NO: 69257 - DNA, 201 bp, Homo sapiens
cacgttgtgatagactctctttctttctttctttttctttctttctttctttctttctttctttctttctttctttctttctctctctctctctctctctytctttctttctttctttctttctttctttctctttctctctctctctctctttctttcttctttttttttggagttttgctgttgttgcccgggctggag

SEQ ID NO: 69258 - DNA, 201 bp, Homo sapiens
cgggcgtggtggcttacacctgaaatcccagcactttgggaggccgaggcaggcggatcacctgaggtcaggagttcgagaccagcctggcccatatggcraaaccccatctctactgaaaatacaaaaattagctgggcgtggtggtgcacacctgtggtcccagctactcaggaggctgaggcaggagaattgcttgaa

SEQ ID NO: 69259 - DNA, 201 bp, Homo sapiens
agtgggattatctgtgggaggggcctccagacatcgagctgggagagccaaatctgctgggaagcagggatgaggagaatcggcctccctggaagaggccrtgctccaagaccagccctcctagtccccgtttgaggtttgctgcttgtgtgcaggtgatgcttctggagacatctcggaggtacaaccctgggagtgaga

SEQ ID NO: 69260 - DNA, 201 bp, Homo sapiens
gtggagaagggagctgaggccagaaaggagcccagttctagaagagtataatctgggtccttcctgcaggacagtgccttggtaatgaccagggctccagraagagatgtccttgtggctgggggcccctgtgcctgacattcctcctggtaagcttcattccatccctctcccctgagcccagaccgcaggctccacgcc

SEQ ID NO: 69261 - DNA, 201 bp, Homo sapiens
actgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacc

SEQ ID NO: 69262 - DNA, 201 bp, Homo sapiens
gattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacag

SEQ ID NO: 69263 - DNA, 201 bp, Homo sapiens
aaagaggtatctgtcaaaggaaaccttttcaaattagttggactaaacgggacctaggccggacatggctcacacctgtaatcccagcactttgggaggaygaggcgggtggatcacctgaggtcagcagttcaagaccagcctggccaccatggtgaaaccccatctctactaaaaatacaaaaattagccagtcgtggt

SEQ ID NO: 69264 - DNA, 201 bp, Homo sapiens
ggtgtggaggaggggcaatgggaaacagcaagagacttacaccaaggagggctgcaggtcccacaggaatcggtggggggaggggggtggtggcttgggarggtggaggcatttgctgtgttattttaggatgagagagcttggctggagcatgtctctatattttggttgcaatttggggtatggaactggaccctggcc

SEQ ID NO: 69265 - DNA, 201 bp, Homo sapiens
atgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatg

SEQ ID NO: 69266 - DNA, 201 bp, Homo sapiens
ggaccctggaaagtggcacgagcgaggttctctaataagcagcgtgtttcactgggtggagtgagctgtcctcagtgttggagtgagggggaaggggcccragagaagcagggcagatgcacccaaacattccctgctggcctggaggggactttgggggagaaaagccggcacggtggctgggagcccagactttggagt

SEQ ID NO: 69267 - DNA, 201 bp, Homo sapiens
agataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctc

SEQ ID NO: 69268 - DNA, 201 bp, Homo sapiens
gggtgtcacaggggcttttctgaaatgtgaaaatgaatacatgggcagattttgcaacagcacccagcctgctgtcttctcacactctgctccccagcccyggcctgttccccctctcccaccctgtgcttcctctcatctttcaccaggctgctcttctgcctcagccttcatctttttctcatctggttccttctgtcc

SEQ ID NO: 69269 - DNA, 201 bp, Homo sapiens; identical to SEQ ID NO: 47617

SEQ ID NO: 69270 - DNA, 201 bp, Homo sapiens; identical to SEQ ID NO: 47569

SEQ ID NO: 69271 - DNA, 201 bp, Homo sapiens
tcgggggagagcgttgaagcactttcctgtatccagagatccgtccacaaaagcggaaaaaggggccagcccccaaaatgctggggaacgagctatgcagygtgtgtggggacaaggcctcgggcttccactacaatgttctgagctgcgagggctgcaagggattcttccgccgcagcgtcatcaagggagcgcactaca

SEQ ID NO: 69272 - DNA, 201 bp, Homo sapiens
ggcgggtggatcacgaggtcaggagatcaagaccatcctggctaacatggtgaaaccccatctctactaaaaatacaaaaagttagccgggtgtggtggcrggtgccggtagtcccagctactcaggaggctgaggcaggagaatgtcgtgaacccagcaggcggagcttgcagtgagcggagatcgtgccactgcacccc

SEQ ID NO: 69273 - DNA, 201 bp, Homo sapiens
cagaagaggcaacccgcataccttcccaggtccatcctgggctgccacctgagttgcctgtcttccttctgccacctccacccctatcccaggcctgccaytgctcatagcagatttcctatcaaaggctctcctggcctcctctcttatctgtggcccccgcagggcacccactttcagaaactccctggaaggcccagc

SEQ ID NO: 69274 - DNA, 201 bp, Homo sapiens
cttcccaggtccatcctgggctgccacctgagttgcctgtcttccttctgccacctccacccctatcccaggcctgccactgctcatagcagatttcctaycaaaggctctcctggcctcctctcttatctgtggcccccgcagggcacccactttcagaaactccctggaaggcccagcacctgcctctctccacccctg

SEQ ID NO: 69275 - DNA, 201 bp, Homo sapiens
catgtctggagaaccagcgtcccctccaggcttgaccccatagctagatcgggtgcagaattgaggcgagggatgggaaagtagaggtcgcttctctccaygcccctgcctttgtggggagattgagccctggccctgttctccaggagatgttttgcttggggtgcaggacacagtatgtaaacaaccctttggactccg

SEQ ID NO: 69276 - DNA, 201 bp, Homo sapiens
taatcccaaatggttcacaaagaccatttattacaggtttcataaatcagcatctctgaatacctgatttaacctagtcctcttactttacagcttaggaracaaacctaaagagaggaagtgacttgcccaaattcacagtttgggcatgggcacagtttgagaatggattaaaagtcaagttttggccgggtgcgtgct

SEQ ID NO: 69277 - DNA, 201 bp, Homo sapiens
ggcatgatcgagaagctcgtcgctgcccagcaacagtgtaaccggcgctccttttctgaccggcttcgagtcacggtacttgacacacctggggagaggcrgctgcgcccagatcaccagtgggcttcttgatgtccgactcaaagcgctttgccttttccctcctgggtagccttggcccatggcaccagatccccatag

SEQ ID NO: 69278 - DNA, 201 bp, Homo sapiens
cccatctctactaaaaatacaaaaattagccagtcgtggtggcgtgtgcctgtaatcccagctaccggggaggctgagacaggagaatcacttgaacccasgatacagaggctgccgtgagccgagattgtgccacttcactccagcctgggcaacagagcgagactctgtctcaaaaaaaaaaataaaataaagagggct

SEQ ID NO: 69279 - DNA, 201 bp, Homo sapiens; identical to SEQ ID NO: 47598

SEQ ID NO: 69280 - DNA, 201 bp, Homo sapiens; identical to SEQ ID NO: 47573

SEQ ID NO: 69281 - DNA, 201 bp, Homo sapiens
taccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggtt

SEQ ID NO: 69282 - DNA, 201 bp, Homo sapiens
ctcccgagtagctggaactacaggcgcctgccaccatgcccggctaattttttgtatttttaggagagacggggtttcaccgtgttagccaggatggtctygatctcctgacctcgtgatccgcctgcctcggcctcccaaagtgctgggattacaggcgtgagccaccgcgcccggccgagaatatattatatttttctt

SEQ ID NO: 69283 - DNA, 201 bp, Homo sapiens
tgcaacagcacccagcctgctgtcttctcacactctgctccccagccccggcctgttccccctctcccaccctgtgcttcctctcatctttcaccaggctsctcttctgcctcagccttcatctttttctcatctggttccttctgtcccatctacaccccctgtccactctttccctgtttcctgtgttctcttccctgg

SEQ ID NO: 69284 - DNA, 201 bp, Homo sapiens
ctgggaatggggcagggggtgaatgaccagcagtaacctcagcagcttgcctcccacatctggactggagcatctgcagggttctcagcctctcccctgtrgcccaccagccctggctgcttccattacagcacttcactggcccaagacgcaacaagacaagattgtcctggactctgacacagcaaagggactggagtg

SEQ ID NO: 69285 - DNA, 201 bp, Homo sapiens
caggaagactgtttccaagaaaaatgtattatttattgaccaggcgcggtggctcatgcctgtaatcccagtactttgggaggccgaggcaggcagatcaygaggtcaagagatcgagaccatcctggccaacatggtgaaatcctgtctctactaaaaatacaaaaattagctgggcgtggtgacatgcaccagtagtcc

SEQ ID NO: 69286 - DNA, 201 bp, Homo sapiens
gagtacagtgacgtgatctcggctcactgcaagctccgcctcccgggttcacgccattctcctgcctcagcctcccgagtagctgggactacaggcgcccrccaccacgcccggctaatttttttgtatttttagtagagacggggtttcaccgtgttcaccaggatggtctcgatatcctgacctcatgatccgcccgcc

SEQ ID NO: 69287 - DNA, 201 bp, Homo sapiens
ggctggagtacagtgacgtgatctcggctcactgcaagctccgcctcccgggttcacgccattctcctgcctcagcctcccgagtagctgggactacaggygcccgccaccacgcccggctaatttttttgtatttttagtagagacggggtttcaccgtgttcaccaggatggtctcgatatcctgacctcatgatccgc

SEQ ID NO: 69288 - DNA, 201 bp, Homo sapiens
tagctgctattcttttttttttttttgagatggagtctcgctctgtcgcccaggctggagtacagtgacgtgatctcggctcactgcaagctccgcctccygggttcacgccattctcctgcctcagcctcccgagtagctgggactacaggcgcccgccaccacgcccggctaatttttttgtatttttagtagagacgg

SEQ ID NO: 69289 - DNA, 201 bp, Homo sapiens
tttatgaatctgggtgctcctgtgttgggtgcatgtagattttgtttagttaggtcttctcattgaattaaaccctttaccattatgcaattctcttgtcttttttttttttttttgacctttcttggtttaaagtctgttttgtctgaaattagtattgcaacccctgcttttctctttttctttttttttaaattatac

SEQ ID NO: 69290 - DNA, 201 bp, Homo sapiens
tgccatctgaacaggcttcagtccccatctccagtctcagggaaagagaatataaatatgttaatgatcctgtttaattcttgtctatttacatgaagttytgacaattctgatagggcgtgcttttctccagtagtaaagtgactagacagatttagcatggtccctagttcatagatctttcgtttcttccttcaccca

SEQ ID NO: 69291 - DNA, 201 bp, Homo sapiens
tgggtgtggtggtgtgtgcctgtaatcccagctactatggaggctgaggcaggagaatcgtgtaagcctgggaggcagaggttgcagtgagctgagatcaygccattgcactccagcccaggtgacggtgcgagactccgtctcaaaaaaaagaaaaaacaacacaaaacaaaacaaaaacttactgaacaaatttatcaa

SEQ ID NO: 69292 - DNA, 201 bp, Homo sapiens
gggagaaagaaggaggttttctaggttcttgattactcccacttttcctttcaggtgacaaatcagacgctaagtttttccttcatggttctgcaagacawcccagtaggagacttgaagccagcaattgttaaagtctatgattactatgagacaggtgagtgaaagaaaaatgaaacaatcttaaccagagccaagaaa

SEQ ID NO: 69293 - DNA, 201 bp, Homo sapiens
taaagacactggtgaaaaagagtcaaagaacaataagaatatgttttgctcatgggagaaagaaggaggttttctaggttcttgattactcccacttttcstttcaggtgacaaatcagacgctaagtttttccttcatggttctgcaagacatcccagtaggagacttgaagccagcaattgttaaagtctatgattact

SEQ ID NO: 69294 - DNA, 201 bp, Homo sapiens
ctgggaggctgaggcaggagaatggcgtgaacccgggaggcgaagtttgcagtgagccgagatcgccccactgcactccagcctgggcgacagagcgagaytccgtctcaaaaaaaaaaaaaaaaaaaaaaggaatgtagttaggacttcagaaaggactaaaaatagtgagttttcaactattaaggaacaaagcatttt

SEQ ID NO: 69295 - DNA, 201 bp, Homo sapiens
gagggaaatatttactgaagcagaacattagaagttagctgattagagttaaaactacagaaagtaagctaagaaatctaggaaaggaaataaattcataragcccacagtgtaaaagcaaatgacttagttaaccaaccaagaaaactggaaggaacctgaacctctgaagtggcatagaaatgctttaggaagcaagga

SEQ ID NO: 69296 - DNA, 201 bp, Homo sapiens
accaggtgatgggctgatacatgcagcaaaccaccatggcacacctatgtaacaaacctgcacatcctgcacatgtaccccagaacttaaaataaaataamatttaaaaaataaataaataaatagataaataataaaagtttttttaaaaactgtgcaaaaaaaggtgagagcaaacagcaaatggtaccaaatttccat

SEQ ID NO: 69297 - DNA, 201 bp, Homo sapiens
ttagagttaaaactacagaaagtaagctaagaaatctaggaaaggaaataaattcatagagcccacagtgtaaaagcaaatgacttagttaaccaaccaaraaaactggaaggaacctgaacctctgaagtggcatagaaatgctttaggaagcaaggacaagctggtaatgaattgaacaacatgtggcagcaaaaaaaa

SEQ ID NO: 69298 - DNA, 201 bp, Homo sapiens
gtcttccagagtttgtatactttttggttttacatttaagtctttaaccaatcttgagttgatttttgtgcattgtgtaaggcggggatccagtttcaatmttctgcctatggctagccagttatctcagcaccatttattgaatagggagtcctttccttgtgtttgttagctttgttgaagatcagatggttgtgggtg

SEQ ID NO: 69299 - DNA, 201 bp, Homo sapiens
aggaaaggaaataaattcatagagcccacagtgtaaaagcaaatgacttagttaaccaaccaagaaaactggaaggaacctgaacctctgaagtggcataraaatgctttaggaagcaaggacaagctggtaatgaattgaacaacatgtggcagcaaaaaaaaaaaaaaaaagaaaagaaaagaaaaaagaaaaagagat

SEQ ID NO: 69300 - DNA, 201 bp, Homo sapiens
tagccagttatctcagcaccatttattgaatagggagtcctttccttgtgtttgttagctttgttgaagatcagatggttgtgggtgtgcagcattatttmtggtctctgcattctgtcccattgatttgtgtgtctgtttttgtacaagtactatgctgttttggtaactgtagccctgtagtatagtttgaagttgggt

SEQ ID NO: 69301 - DNA, 201 bp, Homo sapiens
tgaggcaggagaatggcgtgaacccgggaggcgaagtttgcagtgagccgagatcgccccactgcactccagcctgggcgacagagcgagactccgtctcaaaaaaaaaaaaaaaaaaaaaaggaatgtagttaggacttcagaaaggactaaaaatagtgagttttcaactattaaggaacaaagcattttttaccagag

SEQ ID NO: 69302 - DNA, 201 bp, Homo sapiens
gaggcaggagaatggcgtgaacccgggaggcgaagtttgcagtgagccgagatcgccccactgcactccagcctgggcgacagagcgagactccgtctcaaaaaaaaaaaaaaaaaaaaaaggaatgtagttaggacttcagaaaggactaaaaatagtgagttttcaactattaaggaacaaagcattttttaccagagt

SEQ ID NO: 69303 - DNA, 201 bp, Homo sapiens
aggcaggagaatggcgtgaacccgggaggcgaagtttgcagtgagccgagatcgccccactgcactccagcctgggcgacagagcgagactccgtctcaaaaaaaaaaaaaaaaaaaaaaggaatgtagttaggacttcagaaaggactaaaaatagtgagttttcaactattaaggaacaaagcattttttaccagagta

SEQ ID NO: 69304 - DNA, 201 bp, Homo sapiens
ggcaggagaatggcgtgaacccgggaggcgaagtttgcagtgagccgagatcgccccactgcactccagcctgggcgacagagcgagactccgtctcaaaaaaaaaaaaaaaaaaaaaaggaatgtagttaggacttcagaaaggactaaaaatagtgagttttcaactattaaggaacaaagcattttttaccagagtaa

SEQ ID NO: 69305 - DNA, 201 bp, Homo sapiens
gcaggagaatggcgtgaacccgggaggcgaagtttgcagtgagccgagatcgccccactgcactccagcctgggcgacagagcgagactccgtctcaaaaaaaaaaaaaaaaaaaaaaggaatgtagttaggacttcagaaaggactaaaaatagtgagttttcaactattaaggaacaaagcattttttaccagagtaag

SEQ ID NO: 69306 - DNA, 201 bp, Homo sapiens
caacaatattgggtttcttgtgtcaaattgcctgtccagaaaacaatttaaaaagtaagagtttatgttggcaatggaaagtaagggtagtaaaataatayaagaaaataatagtttttacttgcaaatttactctataaatggcctaaccctgcagatattgaatcatgaatcactgaatcattaaagctttgaagagtt

SEQ ID NO: 69307 - DNA, 201 bp, Homo sapiens
ggcacggtggctcacgcctgtaatcccagcactttcggaggccgaggcgggcagatcacgaggtcaggcgatcgagaccatcctggctaacatggtgaaaycccgtctctactaaaaatacaaaaaattagctgggcggggtggcgggcgcctgtagtcccagctactcgggaggctgaggcaggagaatggcgtgagtcc

SEQ ID NO: 69308 - DNA, 201 bp, Homo sapiens
gcacggtggctcacgcctgtaatcccagcactttcggaggccgaggcgggcagatcacgaggtcaggcgatcgagaccatcctggctaacatggtgaaaccccgtctctactaaaaatacaaaaaattagctgggcggggtggcgggcgcctgtagtcccagctactcgggaggctgaggcaggagaatggcgtgagtcca

SEQ ID NO: 69309 - DNA, 201 bp, Homo sapiens
aggcaggagaactgtttgaacctgggaggtgggggttgcagtgagccgagatcatgccactgcactccagcctggtgacagagtgagactctgtcaagaagaaaaaaaaaaagaaaagaaaagaaaagaaaagaaatgttgaacataggccccaaatctcttatggcttgtagggtgtctgctaagaggcccaccattagt

SEQ ID NO: 69310 - DNA, 201 bp, Homo sapiens
ggcaggagaactgtttgaacctgggaggtgggggttgcagtgagccgagatcatgccactgcactccagcctggtgacagagtgagactctgtcaagaagaaaaaaaaaaagaaaagaaaagaaaagaaaagaaatgttgaacataggccccaaatctcttatggcttgtagggtgtctgctaagaggcccaccattagtc

SEQ ID NO: 69311 - DNA, 201 bp, Homo sapiens
tgtttgtttgtttttcttttagcagtcaagccactctatcatagggctgctgaggtttgctgggggtccactccagaccccagttgctttggtttctcccrtacgtggaagtatcaccagcaaaggccatgaaacagcaaagatggcagcctgtgccttcctctagaaactccatcctgtgggggtactaacctgttgcca

SEQ ID NO: 69312 - DNA, 201 bp, Homo sapiens
aagaaaatctgtgaaaatttgttgactgtaaatagagttcccaaggatgcattctaaaacccatcttgacatccacaaatgtctggtcacctaaagacacyggtgaaaaagagtcaaagaacaataagaatatgttttgctcatgggagaaagaaggaggttttctaggttcttgattactcccacttttcctttcaggtg

SEQ ID NO: 69313 - DNA, 201 bp, Homo sapiens
tttctatttaaatatgatgaatatctagctgtctgcctatctgtctgaaatctattaataacatctgactgtcaatatccagctctcggcttgctctgccytctattcaccctagtttgacacaaccacattttgcctttacagaaccctattgttcgcaatgccctgttctgcctggagtcagcctggaatgtagcaaag

SEQ ID NO: 69314 - DNA, 201 bp, Homo sapiens
gctgtttcaggagctctgggtcactgctcaacaatgccataaaggtgaactgttccacaaacttctgagcctgacacacatcaacataacatcccccaggrgtgaagggaggaaggaggcacaaggaaattgcaaagatgaagtcctggatgatgtgggatggcatcagggaaagagtattacactttctacagagaagga

SEQ ID NO: 69315 - DNA, 201 bp, Homo sapiens
tgaatgaaacccagcagctgacgcaggagatcaaggccaaggccgttggctatctcatcactggtaagtgagacagagaaaaatttactttgttactctartgaaacttttcccaattaagcttcagttatatcatcaaatattaacccatgatgataatttttatgaaaacaacaatcttcccacactctaataggatgt

SEQ ID NO: 69316 - DNA, 201 bp, Homo sapiens
aaagaaaagaaaaaagaaaaagagatgtctaagctaaaaagaaaaagtctccaaactctcagtaacagctaattgactttcttgggtgcacactgtgatgsgggagcctgtgtgtacaaaacagagcagtaaagtgctcaatgaaaagagcctcagcactgcatttttcctccccctaggctcacagcttttgtactgaag

SEQ ID NO: 69317 - DNA, 201 bp, Homo sapiens
catgtggcagcaaaaaaaaaaaaaaaaagaaaagaaaagaaaaaagaaaaagagatgtctaagctaaaaagaaaaagtctccaaactctcagtaacagctrattgactttcttgggtgcacactgtgatgggggagcctgtgtgtacaaaacagagcagtaaagtgctcaatgaaaagagcctcagcactgcatttttcct

SEQ ID NO: 69318 - DNA, 201 bp, Homo sapiens
aaaaaaaaaaaagaaaagaaaagaaaaaagaaaaagagatgtctaagctaaaaagaaaaagtctccaaactctcagtaacagctaattgactttcttgggkgcacactgtgatgggggagcctgtgtgtacaaaacagagcagtaaagtgctcaatgaaaagagcctcagcactgcatttttcctccccctaggctcacag

SEQ ID NO: 69319 - DNA, 201 bp, Homo sapiens
gagagcagaaccctcatgagccaatcacctcttaaaggctccacctctcaatactaccacattggggattaagttttaacatgagttttggtggagaaacmatttctaaaccataatgttaccttatttaattcttatagctaccctgggaagtgagagttattagcttcattttacagaggagaaaacatattcagtgtg

SEQ ID NO: 69320 - DNA, 201 bp, Homo sapiens
tcttcattgatgaagcacacattacccaatctctcacgtggctctcccagatgcagaaggacaatggctgtttcaggagctctgggtcactgctcaacaaygccataaaggtgaactgttccacaaacttctgagcctgacacacatcaacataacatcccccaggggtgaagggaggaaggaggcacaaggaaattgcaa

SEQ ID NO: 69321 - DNA, 201 bp, Homo sapiens
ttccatttagtaaacctgggccaaaagagttgccactgtacatcttatctacgtatttgtatttgaattatcaagttcttgatagctgctattcttttttwtttttttgagatggagtctcgctctgtcgcccaggctggagtacagtgacgtgatctcggctcactgcaagctccgcctcccgggttcacgccattctcc

SEQ ID NO: 69322 - DNA, 201 bp, Homo sapiens
tgaggcagtacaatcacttgagcccagaaattcgaggctgcagtgagctatgattgcaccactgcatttcagcctgggcaacagagcaagaccctgtctcaaaaaaaaattacatttatttaaggtgtacaacataacgttatgggacacatatagataataaaatgactactatagtgatggaaagtaacatggccatca

SEQ ID NO: 69323 - DNA, 201 bp, Homo sapiens
taaaattaatacttgcaaacataagggaagtcatgtaccttttaacagatctaactatttatgtctctagagttgttgggatctgtgaaagtggtaataartgatttacaaattattttctatttttaaagtgaaggaaagttgtaaaaataggtttctgactgacattaccaacatagtcatatgaactgaatataaggg

SEQ ID NO: 69324 - DNA, 201 bp, Homo sapiens
gcaggagaactgtttgaacctgggaggtgggggttgcagtgagccgagatcatgccactgcactccagcctggtgacagagtgagactctgtcaagaagaaaaaaaaaaagaaaagaaaagaaaagaaaagaaatgttgaacataggccccaaatctcttatggcttgtagggtgtctgctaagaggcccaccattagtct

SEQ ID NO: 69325 - DNA, 201 bp, Homo sapiens
aggagaactgtttgaacctgggaggtgggggttgcagtgagccgagatcatgccactgcactccagcctggtgacagagtgagactctgtcaagaagaaaraaaaaaagaaaagaaaagaaaagaaaagaaatgttgaacataggccccaaatctcttatggcttgtagggtgtctgctaagaggcccaccattagtctga

SEQ ID NO: 69326 - DNA, 201 bp, Homo sapiens
gcttccttagattaggtttcaacattctcctgaatctcaatgaccttcattcctatccatagtctgaattctatttctgtcatttcagccatctcagcccwattaagaacccttgctggagaactggtgtgattgtttggaggaaagaagatgctctggctctttgagttgtcagagttcttgtgctggttctttctcatc

SEQ ID NO: 69327 - DNA, 201 bp, Homo sapiens
ttcttcccaaacttaagagctttgcagtataaacacatagtgatataaaataagtaatgttaagctaaagtcaaatttgcatgaagttggaaaaattccayattctacgtagagttataacaatttttaattgagtgccaccaatctcaggctttaatataatcattttaaaaaagtaaattttggccgggcacattggct

SEQ ID NO: 69328 - DNA, 201 bp, Homo sapiens
ccattccagaggctcagatcaagaagcctctattagccctttgtcagatgagtaggttgcgaaaattttctcccattttgtaggttgcctgttcactctgwtggtagtttcttttgctgtgcagaagctctttagtttaattagatcccatttgtcaattttgtcttttgttgccattgcttttggtgttttggacatgaa

SEQ ID NO: 69329 - DNA, 201 bp, Homo sapiens
ctctattagccctttgtcagatgagtaggttgcgaaaattttctcccattttgtaggttgcctgttcactctgatggtagtttcttttgctgtgcagaagytctttagtttaattagatcccatttgtcaattttgtcttttgttgccattgcttttggtgttttggacatgaagtccttacccatgcctatgtcctgaat

SEQ ID NO: 69330 - DNA, 201 bp, Homo sapiens
tgtagatatgcagagttatttctgagggctctgttctgttccattgatctatatctctgttttggtaccagtaccatgctcttttggttactgtagccttrtagtatagtttgaagtcaggtagtgtgatgcctccagctttgttcttttggcttaggattgccttggcgatgcgggctcttttttggttccatatgaact

SEQ ID NO: 69331 - DNA, 201 bp, Homo sapiens
tgctcttttggttactgtagccttatagtatagtttgaagtcaggtagtgtgatgcctccagctttgttcttttggcttaggattgccttggcgatgcggrctcttttttggttccatatgaactttaaagtagttttttccaattctgtgaagaaagtcattggtagcttgatggggatggcattgaatctgtaaattac

SEQ ID NO: 69332 - DNA, 201 bp, Homo sapiens
gaggatgacttgaggtcaggggtttgagaacagcctggccaacatggtgaaaccctgtctctacgaaaaaaacaaaaattagccaggcctggtggcgggcrcctgtagtcccagctacatggggggctggggcacgagaatcgcttgagccgggcagggggaggttgcagtgagccgaaatcacaccactgcgctccaacc

SEQ ID NO: 69333 - DNA, 201 bp, Homo sapiens
tccatgtggttctcttgtcaccaggatgtttctatcttttctccttttctttcctttcatccaaggctgaaggtattgagcaagaaaagactttcagttcyatgacctgtgcctcaggtaagagtccatcttcataatcatagtgagatcaaaaccacaaaggggtataaacctcaagttacaatgcacattcattttatc

SEQ ID NO: 69334 - DNA, 201 bp, Homo sapiens
accgtagatcttggcaacctcagcatacattattttttctttccttatcaagtggggaactttcaccttttcacctaaaggaagcactttacggcttctcyttcacctcccaattgccagcatcaatactctggtgcattggggccatgatgaagtaaaataagggtgacttgaacacaagcactgagatactgtgacaat

SEQ ID NO: 69335 - DNA, 201 bp, Homo sapiens
agtgggagctgaatgatgcaaacacatagacacatggaggcgagcaacatatatggggcctgtctgagagtgggagtgacagaagggagagcatcaggaakaatagctagtggatgctgggcttaatccctaggtgatgggatgatctgtgcagcaaaccaccatggcacacatttacctatgtaacaaacctgcacctcc

SEQ ID NO: 69336 - DNA, 201 bp, Homo sapiens
ttagcgcttgcagaattctttgctgcaagttaggttatatgccaggaacattcttgaagctgacacacaactcagctttctcagttccacgagagtcattmtccaacccgtcatcttgaaatctccaaaatatataattttaatttatcttatagcacttatctctttgtaaattatgtaatagtggttgtatatagatca

SEQ ID NO: 69337 - DNA, 201 bp, Homo sapiens
cttcacttgccctcctccccagctcatcaggtgtggctgaggtaggagtaacagtccctgacaccatcaccgagtggaaggcaggggccttctgcctgtcygaagatgctggacttggtatctcttccactgcctctctccgagccttccagcccttctttgtggagctcacaatgccttactctgtgattcgtggagagg

SEQ ID NO: 69338 - DNA, 201 bp, Homo sapiens
ctgaattgtttatttcagatgtcaaaaaataagtggaataaaatctaatgctctaatcttatttcccagagaacaacagttttgcaaagttccatacagtratttaaagtaaatttaatttatgtaaaagtaatttaatgtaaatcattaaattctgttcactccactggtaatttcatttttagtatagcaaccactctc

SEQ ID NO: 69339 - DNA, 201 bp, Homo sapiens
tgtactgtaagagagggaaaatgctgacaatggaaagaaagagtaattctgattatggaaacaggaaagacattcatagggatgctgtattttaaaaaacmtaaagaaggacaaagggcttcactggtgacaagaaacaacgtgaacatcacagaaatatctcataatccatggccaaaaccactattcaaatacagcagc

SEQ ID NO: 69340 - DNA, 201 bp, Homo sapiens
tacacacaaagaaaccaagattcaaattaattgtttcttgctgaggtgacttagctggtgatagctagaactgatcagagatttttttttagatacatccratacttcagggcacaaaatcagataaaatacaagattctgatgtactgtaagagagggaaaatgctgacaatggaaagaaagagtaattctgattatgga

SEQ ID NO: 69341 - DNA, 201 bp, Homo sapiens
  misc_feature (1)...(201): n = A,T,C or G, or insertion/deletion polymorphism (see Tables 1-2)
acaagtagattgaacaattatttttttccaggggatgggattgaaggtgttcactaactcaaaaatccgaaaaccaaagtcgtgttcagtcatcccttccntgtctgcaggagcagtaggtcaaggatactatggaggtaaaacagcaatttgcttttaattttatttcatgtccaacaatattactatgcccaaaatgct

SEQ ID NO: 69342 - DNA, 201 bp, Homo sapiens
attaacatgctggcttgtgagtttttgaatgttaataaaactctgtatctattcataatcttagtaattatgtagccttgcctctccatttttcagcagasaaaaatgaagccaataaaaaggttaaagtctcttgtgaggatcacacaaaagctcagtatgtgagtcagggctagatctaacctctgcctattcatctgg

SEQ ID NO: 69343 - DNA, 201 bp, Homo sapiens
ccctagtttgacacaaccacattttgcctttacagaaccctattgttcgcaatgccctgttctgcctggagtcagcctggaatgtagcaaaggaggggacycatgggagccatgtctacaccaaggcattgctggcctatgctttttccctactgggaaagcaaaatcagaatagagaaatactgaactcacttgataagg

SEQ ID NO: 69344 - DNA, 201 bp, Homo sapiens
tttgcctctgggtctttgaggaatcaccacactttcttccacagtggttgaactaatttacactccccacaacagtaaaaaaagcattcctttttctctgyaacctcatcagcatctgttgttttttgactttttaacagcagccattctgactggtgtgagatggtatctcattgtggttttgatttgcatttctctaat

SEQ ID NO: 69345 - DNA, 201 bp, Homo sapiens
agccattctgactggtgtgagatggtatctcattgtggttttgatttgcatttctctaatgattagtgatgttgagcttttcttcatatgtttgttggctrtatgtatgttttcttttgagaattgtctgttcatgtcctttgcccactttttaatgggtttttatttcttgtaaatttgtttaagttcctcgtagactct

SEQ ID NO: 69346 - DNA, 201 bp, Homo sapiens
gatttgtgtatgttgagccaagcttgcatcccagggatgaagcctacttggttgtggtggataagctttttgacgtgctgctggatttggtttgcaagtaytttgttgaggatttttgcatcgatgttcatcagggatattcgcctgaagctttctttttttgttgtgactctgccaggttttggtatcaagatgatggtg

SEQ ID NO: 69347 - DNA, 201 bp, Homo sapiens
gtgaaaggaaggggtccagtttcaattttctgcataaggctagccagcattcccagcaccatttactaaatagggaggcctttcctccattgcttgttttygtcaagtttgtcaaagatcagatggttgtaggtttgcggttttatctctgagttctctattctgtaccattggtctatgtgtctgttctttatcagtacc

SEQ ID NO: 69348 - DNA, 201 bp, Homo sapiens
cttgcctgttgttggtgtatagaaatgcctgtgatttttgcacattgattttgtatcctgagattttgctgaagttgcttatcagcttaagaatcttttgractgagataatggggttttctagatataaaatcaaataaagataatttgactttctctcttcctattcgaatacactttatttatttctcttgcctgatt

SEQ ID NO: 69349 - DNA, 201 bp, Homo sapiens
ttggtgtatagaaatgcctgtgatttttgcacattgattttgtatcctgagattttgctgaagttgcttatcagcttaagaatcttttggactgagataayggggttttctagatataaaatcaaataaagataatttgactttctctcttcctattcgaatacactttatttatttctcttgcctgattgccctggccag

SEQ ID NO: 69350 - DNA, 201 bp, Homo sapiens
ttagcccccttcctagggatatatacaaacagatttcctgcctttccagggatcccagggccggattatgtaaaactccagggtttctgtgtgcctgagcwgctgctctgccaagactccacatagctttgtgtatcagacccaagaccctggtggcatgggctcacaagggtatctcctgatccatgggttgcagagatc

SEQ ID NO: 69351 - DNA, 201 bp, Homo sapiens
tttctcccatacgtggaagtatcaccagcaaaggccatgaaacagcaaagatggcagcctgtgccttcctctagaaactccatcctgtgggggtactaacytgttgccagcccacatgcaactgttggaggtggctggagaccctcattgggaggtctcgcccagtcaggaggaatgggatcagggaccttctcaaagaag

SEQ ID NO: 69352 - DNA, 201 bp, Homo sapiens
gcccttgctggtgaggtgtcacagtcatctggaagagaagagacactctggcattttgagttttcgttgtttttgaattaattctttctcatctttgtgarcttatctacctttaatccttgaggctgctgccctttgaattagatttgtgttaggtcttttttgttgatgctgttgttttctgtttgtttgtttgttttt

SEQ ID NO: 69353 - DNA, 201 bp, Homo sapiens
ggcccccaatttcttctggcttccatggttttggcagagaggtccactgttagtatgatatgtttccttttgtaggtgacttggcctttctctctaggtgyccttaacatggtttctttcattttggcattggagaatctgatgattttgtgtctttgggttgatgttcttgtggagtatcttactggccttctctgcatt

SEQ ID NO: 69354 - DNA, 201 bp, Homo sapiens
gaagtcaggtaacatgatgcctccagctttgttcttcttgcttagaattgtcttggcaattcaggctcttttttggttccatatgaattttaaaatagatktttctaattctgtgaagaatgtcaatggtagtttaatgggaatagcactgaatctataaaatactttgggcagtatggccattgtcattacactgattct

SEQ ID NO: 69355 - DNA, 201 bp, Homo sapiens
tccacagcctgacctctgatccccagcaattcatgagctctcacatgtaaaatatactcgatcctctctctgagattctcattgtaaaataggaacagctsaaaggctaaatatcatttaaatcaggtccaagtacagataatgcctctcaggtgtgattcctcaggtacaatacctctagatacaaagacattgaactaa

SEQ ID NO: 69356 - DNA, 201 bp, Homo sapiens
gggtctagcttgtgacctgccctggttgcgattaacatggcggccaaagctgcagccacctgacagcttgacagaggttggaagatctgcttccaagacargtttcttgagagctattggcaggaggcctcagttcctcaccacacagaggtcctagggctgctggtgtcccacaatgtgacaactgattttctccagagc

SEQ ID NO: 69357 - DNA, 201 bp, Homo sapiens
ataaataatacatgttcatttatgtacctatttaattctactcaaaaacaaaggtaaataaagaagtagaaagggtgtttgcgttacctatctactgctgyataacaattttcttcaaaacctagtggcttaaaacaataaacatttattatcacatgcaatttctgtgagtcaggaattcagagcagcttagctaggtgg

SEQ ID NO: 69358 - DNA, 201 bp, Homo sapiens
aaactgtgagataactatatctgagacccctgtcctatttttaattatcaaaattaacattcttcaggttggagcatatccactagtgccccctgatctgyaggggtgtgtcccaagaccttcagtgggtgtctgaaactgtggatagcactgaacccaatgaccatcagctggaacacatttctgttcctgtcttccacc

SEQ ID NO: 69359 - DNA, 201 bp, Homo sapiens
tcaggatagatagctaatgcatgggggacctaataaccaggtgatgggctgatacatgcagcaaaccaccatggcacacctatgtaacaaacctgcacatyctgcacatgtaccccagaacttaaaataaaataaaatttaaaaaataaataaataaatagataaataataaaagtttttttaaaaactgtgcaaaaaaag

SEQ ID NO: 69360 - DNA, 201 bp, Homo sapiens
agtaaaatataacagtaaaaatacgtaccacttgccgagtacttgatagtttctcaagctgtctcatataggttttctcacttaatctgcccaacattccrgagaataatagtcccattttaagattagaaaagtggattcagaatagttgagagatttgttcaagataagtggcacaagctgagatgtgattttgaaatt

SEQ ID NO: 69361 - DNA, 201 bp, Homo sapiens
atttttgtgctgatctgtgacagaacctccattgacttagtccattgacttttagaataaaactgattgcaccaattaatacatattgttatgaaaacacmtttatggatgaaaacgcttactatcatcagtttttctctaatttagacttcttcctttcccaggcagtatatggtgctggtcccctccctgctccacact

SEQ ID NO: 69362 - DNA, 201 bp, Homo sapiens
aggtgtgagtaatgaacgaatatgggaaataaaacaatagtttactttccataacaaaataaaggtcatttgtaagaaagaaattttatgactaaagtaayttctaaaagtactgactctttatatttttcagacctggaagtcactgcaaacaggatcagtgaaatcacaaacattgtatccaaactcaaattcgtgaaa

SEQ ID NO: 69363 - DNA, 201 bp, Homo sapiens
tctctgggtgttgttcacatcaactatcaagtacttttcttctttaggtgcttctggtggatggaaaaggtgtgcccatccccaataaactcttcttcatytctgtgaatgacgccaattattactccaatgcaaccaccaatgagcagggtcttgcacagttttcaatcaatactaccagtatctcggttaataaacttt

SEQ ID NO: 69364 - DNA, 201 bp, Homo sapiens
tcatttatttggctgtcgaccagtatgagggagaggcatagtgtattttagagtggaagacaccgttgtaactattcattttggtgagaagctaaggtgamgaatttcaagacagtattctttctttgcttttctgtttactcaggttttcactgtgcatcccaacttgtgttttcactattcatgggtagcagaagacca

SEQ ID NO: 69365 - DNA, 201 bp, Homo sapiens
gttcttagtcaacaagattctcatttggacgactaactttggaggttacaaagcagatatgagtattaagttctcgaaggtcaattaacttacttaatgcaaaaaaaaaagttttcttgtcattagagacagaatagtagattcagtgactattgatctcaatcagtttgacatttattggttttggtatttttctcagct

SEQ ID NO: 69366 - DNA, 201 bp, Homo sapiens
gagttcagtcctctctgggtgttgttcacatcaactatcaagtacttttcttctttaggtgcttctggtggatggaaaaggtgtgcccatccccaataaastcttcttcatctctgtgaatgacgccaattattactccaatgcaaccaccaatgagcagggtcttgcacagttttcaatcaatactaccagtatctcggt

SEQ ID NO: 69367 - DNA, 201 bp, Homo sapiens
aggaacctgaacctctgaagtggcatagaaatgctttaggaagcaaggacaagctggtaatgaattgaacaacatgtggcagcaaaaaaaaaaaaaaaaaraaaagaaaagaaaaaagaaaaagagatgtctaagctaaaaagaaaaagtctccaaactctcagtaacagctaattgactttcttgggtgcacactgtgat

SEQ ID NO: 69368 - DNA, 201 bp, Homo sapiens
catgcttatagcagtgccaacatttgaagtggtgccttatacatttcatcacctacaatggaagtagttaactctggaagaggttacaaaacaacaaaaasggactgattcagttggagagaaaaaaaaagaaagaaaagaggtacaacaaacagaaaatgcaataacattttcaaactatttttatctctatttgccaga

SEQ ID NO: 69369 - DNA, 201 bp, Homo sapiens
tcattaagtctctcgtggttttataattaccgttattcaactaaatgtgggccatctactcaagtccccagtggaccattcagaaaatggaacttttgttsttgcccttttgtagctacctggtggcccttcaccctgctttaaaatgtaaagtattttctgaagtgttatctggtaccatttaatgcttccagtagaaat

SEQ ID NO: 69370 - DNA, 201 bp, Homo sapiens
ggaatatttgaggaccatgagaatttaaaggaaagacttaagacatcccccataacacttttcactaagccctatgttaatatattagcaacatggagacktacaacgagcatctttaccctctaaagccacgctatggtcattggacacattctagaccagagtttttcagcatcaacactattgacatttcgagccaca

SEQ ID NO: 69371 - DNA, 201 bp, Homo sapiens
cagcagtggcaaggcagggtgcacacacacacatgtgttggcaaattttattattaaaagctttaatttcctaccactattctttgccataaagtcaccayaattttttttctggttttatgacatttcaatctaccccactttccttgttgaactcaagacagtgataaaagggcttccttccttttagaaggggagctt

SEQ ID NO: 69372 - DNA, 201 bp, Homo sapiens
ttgcccccattgcacgaatgttcatctttgccattttaccagatggagaagttgttggagactctgaaaaatttgagattgaaaactgtctagccaacaargtgagcgatttaacataaaattaaaagaacacaaataaatgatactgtaggtgccatctattttaccccagagaaaactaagtccagaaaagtaaaatga

SEQ ID NO: 69373 - DNA, 201 bp, Homo sapiens
tatccttccctgtggagtcagacgttgcccccattgcacgaatgttcatctttgccattttaccagatggagaagttgttggagactctgaaaaatttgarattgaaaactgtctagccaacaaggtgagcgatttaacataaaattaaaagaacacaaataaatgatactgtaggtgccatctattttaccccagagaaa

SEQ ID NO: 69374 - DNA, 201 bp, Homo sapiens
tagtttggctagatatgaaattcttggttggaatttattttctttaagaatgttggccaggtgcagtggctcatacctgtaatcccagcactttggggggycaaggtggtcagatcatgaagtcaggagatcgagaccatcctggccaacatggtgaaaccccatctctactaaaaatacaaaaattagccaggtgtgatg

SEQ ID NO: 69375 - DNA, 201 bp, Homo sapiens
tccaggggatgggattgaaggtgttcactaactcaaaaatccgaaaaccaaagtcgtgttcagtcatcccttccgtgtctgcaggagcagtaggtcaaggrtactatggaggtaaaacagcaatttgcttttaattttatttcatgtccaacaatattactatgcccaaaatgctaaaatgaggtaatgtagccctatttc

SEQ ID NO: 69376 - DNA, 201 bp, Homo sapiens
ttgggtcctgtgctgagttcagatcctaaatttctgccttgatgatctgtctaatactgtctgtggagtgttgaagtttctcaatattattgtgtgggagyctgagtctctttgaaggtctctaagcacttgttttatgaatctgggtgctcctgtgttgggtgcatgtagattttgtttagttaggtcttctcattgaat

SEQ ID NO: 69377 - DNA, 201 bp, Homo sapiens
gaattctattttaatcacatggtagtccgagagtgtggagtgtatgatttcatttttctaaatttgctgaggatagttttatgtctgattgtgtgatcggytttagagtagtgccgtgtgcagttgagaagaatgtatgtgttgttgttttgtagtggatagttttgtagatgtctatcagatccatttgggtcctgtgct

SEQ ID NO: 69378 - DNA, 201 bp, Homo sapiens
cagagaaaaaggaaaggtaattagtgaagatctaccttaggggtaaaaagccagcttccctcatggtaggctaacacagactttgggggaaaatcccagaygccaaaaatttactctttggggcggttgtccactcgtctcttccaggacacagtggtggctctccatgccctgtccaggtatggagcagccactttcacc

SEQ ID NO: 69379 - DNA, 201 bp, Homo sapiens
cagatctcattgccagagctccctggagaatatgtcataacagtaactggggaaagatgtgtgtatcttcaggtagggctccaagcttatatgggtgagartcaactttaaacttgccaattgaaatggaaactctgttccttccttcctgggaaagtaaaaggcacctctggagacgttaagtaatgaggaagtgagggg

SEQ ID NO: 69380 - DNA, 201 bp, Homo sapiens
atgagttttcttgaggttgattctctccagcacagacttgacaactgaaagtgggtcatgtggggaatagaaggctgagaactgtgtccagctcaagaaayttccttcactgttttttcatttcagatcatggctaagggagtcatcgtcagatctggaacccacactctgcctgtggagtcaggagacagtgagtatcct

SEQ ID NO: 69381 - DNA, 201 bp, Homo sapiens
ctgatagtgtctttgctgtttcacagacatccatgaaatacaatattcttccagagaaagaggactccccatttgctttaaaagtgcagactgtgccccaracttgcgatggacacaaagcccacaccagctttcagatctcactgaccatcaggtaagacgttctaacctaatcacctatctttggcccaaaagcaactt

SEQ ID NO: 69382 - DNA, 201 bp, Homo sapiens
gtcacaagcagaaggggtgttttctccctttataaggagaaaacttaacttcatccctccagaattaacccttgatgtgataaatgtgagagactacaaargagaaccaatagccattctcccctgccttggggcagtaagcttcagaaagatgaaggtttcaggggaataaaatgaaaaagagaaaattaaaagttatca

SEQ ID NO: 69383 - DNA, 201 bp, Homo sapiens
cctcacatggggtgataggtcagtgtgcagctgaaagcctctccagccttcctagcttcccaaaatacaaagggagaagaatcctattgtatctgtggaartgagagacaaaccttgtcttggacagtgactcctaaaactctgggtgagtgacagtacccaaaagggcctatcaatcaacaaggacggtggctgtctgag

SEQ ID NO: 69384 - DNA, 201 bp, Homo sapiens
agaaggactaatttaaggtatattcatgttatctatttataaacatgggaatccattcaaatatagtgtaagggaggcagtaaaataacttgtattatcayggttataagtcttaatattgctacaaaagtggagagcgatagttcccccactaagtcttaggcttcttttagaaagctactgagcacagccatgcaaaaa

SEQ ID NO: 69385 - DNA, 201 bp, Homo sapiens
cctcccctatcagaacttactgttttcactaggcattctgctgcttctctgtgcctccatctcttaagcagtagacagagggcatgaaccttacctatgaygttcctttccactgttgccctctgtgattacagatacctcttacagttccttttaacctgaagaagcaaaactgatagcctacaaacaaacagtcccaga

SEQ ID NO: 69386 - DNA, 201 bp, Homo sapiens
tgcttataatcccagaactttgggaggccaaggggggaggatcgcctgaggccaggagttctagatcggccctagtaacatagtaagactctacctctgcaaaaaaaaaaaaaaaaaaaaaaattagcagtgggctggtggcgtgcacctgtagtcccagctgcttgggaagctgaggtgggaggatccctcgagcccaga

SEQ ID NO: 69387 - DNA, 201 bp, Homo sapiens
cctacattattttgctaagaatgatagcttctagctccatgtatgctcctgcaaaggacatgatggcgttcttttttatggctgcatagttccatggtgtrtatgtaccacattttctttattcagtcttccactgatgggcatttaggttgattccatgtctttgctactgttcattgcaacagggttgcaatgaacata

SEQ ID NO: 69388 - DNA, 201 bp, Homo sapiens
acacaaatatgaatggcataacactgccttaaggatattttaagcttcctttcttcccaaacttaagagctttgcagtataaacacatagtgatataaaayaagtaatgttaagctaaagtcaaatttgcatgaagttggaaaaattccatattctacgtagagttataacaatttttaattgagtgccaccaatctcagg

SEQ ID NO: 69389 - DNA, 201 bp, Homo sapiens
aaactctgtatctattcataatcttagtaattatgtagccttgcctctccatttttcagcagagaaaaatgaagccaataaaaaggttaaagtctcttgtraggatcacacaaaagctcagtatgtgagtcagggctagatctaacctctgcctattcatctggatactttttagttatatttaggtttttttatttgcaa

SEQ ID NO: 69390 - DNA, 201 bp, Homo sapiens
aaaaaaataagtgcactttgaagaaaagctaaggagcagttaccacaagggaaatagaattgtgcgcaaaacattatctgcaaggcttaaagtttcagaartcacataggtcttaaaggttggaagtcacaataatgataagaggcataaatgctaatttactaaggattactaaaaacaattttgaagctcataaggtaa

SEQ ID NO: 69391 - DNA, 201 bp, Homo sapiens
tgaagcttccgttgctgtaactttcaggttccgaagagcaagtagtgattagggtgtagcatggatcacctgcacagcacagctgacccactagttctttyagttgtgatgtgaggttaagttgagatctttctaacttttcgatgtggatgtttagtgctataagtttccctcttaacaccgccttagctgtgtcccaga

SEQ ID NO: 69392 - DNA, 201 bp, Homo sapiens
acaattcctgctcagtttctctaagaatgaagcaatactgtctcaatttcaaaattggtccttcgccacaaaacccataaaactgtctccaagtgatctcrtttttccagcttccattcacatcaaattatgctatgtctaggatacatagaatttccacctttgacaaagactcctctcttttcagggaatgagggatca

SEQ ID NO: 69393 - DNA, 201 bp, Homo sapiens
tcaggaatattggtttgcaaatattttgttgaggatttttgcatcaatgttcatcaaggacgtttggccagactattttttatgtgagtcccacttctcckcatgggggcaaccccacaacctgggactgcagccaccaccaccccacccccatcagggttttcaggctggtagcaactttacatttccctgggacggagc

SEQ ID NO: 69394 - DNA, 201 bp, Homo sapiens
cttgcatcccagggatgaagtctacttgatcgcggtagctaagctttttgatgtgctgctggattcagtttaccagtattttattgaggattttcgcatcratgttcatcaggaatattggtttgcaaatattttgttgaggatttttgcatcaatgttcatcaaggacgtttggccagactattttttatgtgagtccca

SEQ ID NO: 69395 - DNA, 201 bp, Homo sapiens
ccaaccttgcatcccagggatgaagtctacttgatcgcggtagctaagctttttgatgtgctgctggattcagtttaccagtattttattgaggattttcrcatcgatgttcatcaggaatattggtttgcaaatattttgttgaggatttttgcatcaatgttcatcaaggacgtttggccagactattttttatgtgag

SEQ ID NO: 69396 - DNA, 201 bp, Homo sapiens
cctttcttctttttgcttaggattgccttggctatttgggctctttttttagttccatatacatttttaaatagttttatctaggtctgtgaaggatgtcrttggtagttttataggaaaaacattaaatctataaattgctttgggcaatatgaccattttcatgatattgattcttcctatctatgagcatggaatatt

SEQ ID NO: 69397 - DNA, 201 bp, Homo sapiens
aaaagtggtcaataggctcaggaatgtcaaaataaactacttgcacacagccaccttgtgttcttgttgtgcgtccttcattccatgagttttcttgaggytgattctctccagcacagacttgacaactgaaagtgggtcatgtggggaatagaaggctgagaactgtgtccagctcaagaaatttccttcactgttttt

SEQ ID NO: 69398 - DNA, 201 bp, Homo sapiens
caagacagtattctttctttgcttttctgtttactcaggttttcactgtgcatcccaacttgtgttttcactattcatgggtagcagaagaccaccagggygctcagcacactgcaaatcgtgttttctccttaagtggaagttacattcacctggagcctgtggctggtaccctgccctgtggccacacggagactatca

SEQ ID NO: 69399 - DNA, 201 bp, Homo sapiens
aatatttgaatgttgggagactgaaaattcatttatttggctgtcgaccagtatgagggagaggcatagtgtattttagagtggaagacaccgttgtaacyattcattttggtgagaagctaaggtgaagaatttcaagacagtattctttctttgcttttctgtttactcaggttttcactgtgcatcccaacttgtgtt

SEQ ID NO: 69400 - DNA, 201 bp, Homo sapiens
gctgatctgtgacagaacctccattgacttagtccattgacttttagaataaaactgattgcaccaattaatacatattgttatgaaaacacatttatggrtgaaaacgcttactatcatcagtttttctctaatttagacttcttcctttcccaggcagtatatggtgctggtcccctccctgctccacactgaggcccc

SEQ ID NO: 69401 - DNA, 201 bp, Homo sapiens
catctgttctctaactttaactgaagttttctaattctctccagcttgaaagatctagctctgtgagccggacagaagtgagcaacaaccatgtcctcatytatgtggaacaggtgagggctctgacatcctggctgagactacatatgggtcgtctttctaagtgagtctctttactagaatagtcggtaacatgaggaa

SEQ ID NO: 69402 - DNA, 201 bp, Homo sapiens
cattcacatgggcccagagagttaatctcataacaagggactacaaaagaatagggttggctcagttgtttagaagaaaatctgtgaaaatttgttgactktaaatagagttcccaaggatgcattctaaaacccatcttgacatccacaaatgtctggtcacctaaagacactggtgaaaaagagtcaaagaacaataag

SEQ ID NO: 69403 - DNA, 201 bp, Homo sapiens
cgtttcttccttcacccaacgttatctttcagatgagtctgtggttgctgagtatatcgccccctgcagcacaggtaagagttcaccacttatgaccagtrctagatggcattaacccactctccaagggcccctgcaatttaaattctctacaaggcttttcctacatctgagacaatccacatggcatgtcctcacacc

SEQ ID NO: 69404 - DNA, 201 bp, Homo sapiens
ctgaggcagcaaaattgcttgagcctaggagcttgaggctgtcatgtgtgatagtgctactgcactccagcctgagctacagagcaagaccctgtcgagaragagagagagaaggaaatggtatactttgaatggaaacagatactgaggagcgtttccatcaaacaacagaagagaatatactaacacttggcactggaa

SEQ ID NO: 69405 - DNA, 201 bp, Homo sapiens
ctcttgtgaggatcacacaaaagctcagtatgtgagtcagggctagatctaacctctgcctattcatctggatactttttagttatatttaggtttttttwtttgcaaaccaaaaaataatgaataaagaataaaatcttaataatccataagtttagtaatttcactactctatatttactgtcaagtgtttcgccatag

SEQ ID NO: 69406 - DNA, 201 bp, Homo sapiens
tcagaggtggcattccttagcatccagataaaggggcctacgcaagatttcaggaagaggaacacagttctggtactgaacacccaaagtctggtctttgkccagacagacaaacccatgtataaaccaggacagacaggtaagtagggaaattccactgtttggggcaacactgagaagggccacctgaacagccaaagt

SEQ ID NO: 69407 - DNA, 201 bp, Homo sapiens
atttctcagactgataagctctttggttgatgcattaagagagatttacacttgcccagtaatgcccatagactatgtatcaaaaccaatcctaaaaacasgttctctagtcttattctttaagactgaactataaagggaagagatcgaaatatttttctatttaaatatgatgaatatctagctgtctgcctatctgtc

SEQ ID NO: 69408 - DNA, 201 bp, Homo sapiens
tcctgagacttggatctgggagttggtggcagtgaagtaagtaactttactttcctccatttgctggaggggagggaatgtggttcctccaacattttcawttctaagacaatcttcctgaaaagttctgaataattatcttaacctcttcctctttaggatagacctaagtaaaatgcgcaattgcataggctcattaat

SEQ ID NO: 69409 - DNA, 201 bp, Homo sapiens
cttaagtggattcagttcttgacgttagctttatgcatattaattctcacttgagaaaaggtggcttacattcattatttctgttcttcacttgccctccyccccagctcatcaggtgtggctgaggtaggagtaacagtccctgacaccatcaccgagtggaaggcaggggccttctgcctgtctgaagatgctggactt

SEQ ID NO: 69410 - DNA, 201 bp, Homo sapiens
aatcacatctcttctttccttttatcatatagattccactgatataccttgaggtaagtatcagaaaaagtatcttataaggaaattagtgcttttagagrgtaggaggttctgataatactctagacagatgaactactttaaaaattttcagatctgaattcctcctactcccagttgtcaggttgattgtattttctc

SEQ ID NO: 69411 - DNA, 201 bp, Homo sapiens
tttcatcatatattttgctttaacatcttaggataaatcacaaagatcatgatatttttctgtacatgcagtagtatgtacctctaaaatacagagacatygtccacttctgcgacaacacgatcacttaacaaaattggaagtaattttccaaaactaattgcaagtttacagtcaagtatcttcaattgtcctaaaaat

SEQ ID NO: 69412 - DNA, 201 bp, Homo sapiens
aattataaatttactttgcctcagcacttttgtaatattactcctttgacttctctttatttaacgacttactattaaaattttcaaatacataaaagaayagaaacacacttaattatgatttaacaataaacatctttccgtattgtttcatcatatattttgctttaacatcttaggataaatcacaaagatcatgat

SEQ ID NO: 69413 - DNA, 201 bp, Homo sapiens
agataatcagtatcatggatgaaaaagtgaacataacagtctgtggagagtgagttacattgtttttatctaaaattttatattttgcctcaattttgagkgattatgtaggtacaaaattataaatttactttgcctcagcacttttgtaatattactcctttgacttctctttatttaacgacttactattaaaatttt

SEQ ID NO: 69414 - DNA, 201 bp, Homo sapiens
aatctcctccagatgccatatggctgtggagaacagaacatggtcctatttgctcctaacatctatgtcttgaactatctgaatgaaacccagcagctgaygcaggagatcaaggccaaggccgttggctatctcatcactggtaagtgagacagagaaaaatttactttgttactctaatgaaacttttcccaattaagc

SEQ ID NO: 69415 - DNA, 201 bp, Homo sapiens
cttgaggtaagtatcagaaaaagtatcttataaggaaattagtgcttttagagagtaggaggttctgataatactctagacagatgaactactttaaaaawtttcagatctgaattcctcctactcccagttgtcaggttgattgtattttctcttccttctgtatttgtctttccagaggcaatgctaattatcaccttc

SEQ ID NO: 69416 - DNA, 201 bp, Homo sapiens
tttcaacttaccttcaatattagtgcaaaggaacaaagctgcttttaataggtagaaaatagacaatgttgaaattagaagaaatattcttggtttacttkcaaccaaatgattctgggaattctatttctgttaggtctaaatcataatgacatataactctattaatatctatttcccaacttatgaaagtaagcagta

SEQ ID NO: 69417 - DNA, 201 bp, Homo sapiens
catatagtatagaaatatattatacacaaagacttttttatgctaattgaatttcccttttttcaacttaccttcaatattagtgcaaaggaacaaagctrcttttaataggtagaaaatagacaatgttgaaattagaagaaatattcttggtttactttcaaccaaatgattctgggaattctatttctgttaggtcta

SEQ ID NO: 69418 - DNA, 201 bp, Homo sapiens
tcttgcctcagcctcctgagtaactgctactacagccatgtgccacctggctaaattttttattttaatttttgtagagatgggggacctcacaatgttgygcaggctgttctcaaactcctggcctcaagtgactctcctgcctcagcctcccaaagtgccgggaactaggtataagccacttctcccagcctgaacctg

SEQ ID NO: 69419 - DNA, 201 bp, Homo sapiens
aattatctcgtgttcttaattgtgacaagcaggaggtctgtgaggaattcagtcaacaggttagtaggcggtattctccctcagtgctatcactgtttacraccagtgagactccattttactaactagaaagagggcatcaggacaagcttgtcgcaaaatatcccccaccaaaaaacgaatttctgttcttagtcaaca

SEQ ID NO: 69420 - DNA, 201 bp, Homo sapiens
cccaggacttgcaactgtgagcctgtgtagaaaattatctcgtgttcttaattgtgacaagcaggaggtctgtgaggaattcagtcaacaggttagtaggyggtattctccctcagtgctatcactgtttacaaccagtgagactccattttactaactagaaagagggcatcaggacaagcttgtcgcaaaatatccccc

SEQ ID NO: 69421 - DNA, 201 bp, Homo sapiens
gtaggcaactctaaagagggacagttctgtggaggagtggtagtggaaaatgcaaacagccattctcaattcctgatttatttctcatgtaccagatacayttatgggaagcctgtcccaggacttgcaactgtgagcctgtgtagaaaattatctcgtgttcttaattgtgacaagcaggaggtctgtgaggaattcagt

SEQ ID NO: 69422 - DNA, 201 bp, Homo sapiens
atgtattaattaaacacagatgcaagttacgtcttctttctatatttggtctatttttacctctagactctacaatgaagttttaattaatccttcataayttaagattttgttaatctttggaagcattttcccaagtaggtttcatttctttataacaaaacaacactgttaaatataaggaaaatcttcaactatctc

SEQ ID NO: 69423 - DNA, 201 bp, Homo sapiens
catgcttcttaaagcatggatgaatctatgtgacatacatttttcttacaaatcccaatttactgcagcatctcacacttggccccaattctatgtgttcrtgtcgttccatattctgatcatttctgtctctgcctcacatggggtgataggtcagtgtgcagctgaaagcctctccagccttcctagcttcccaaaata

SEQ ID NO: 69424 - DNA, 201 bp, Homo sapiens
aatcttgatttgtatcattgccattgccatgcttcttaaagcatggatgaatctatgtgacatacatttttcttacaaatcccaatttactgcagcatctyacacttggccccaattctatgtgttcatgtcgttccatattctgatcatttctgtctctgcctcacatggggtgataggtcagtgtgcagctgaaagcct

SEQ ID NO: 69425 - DNA, 201 bp, Homo sapiens
atgccaaatcctcctaatacacaaccaatcttgatttgtatcattgccattgccatgcttcttaaagcatggatgaatctatgtgacatacatttttcttmcaaatcccaatttactgcagcatctcacacttggccccaattctatgtgttcatgtcgttccatattctgatcatttctgtctctgcctcacatggggtg

SEQ ID NO: 69426 - DNA, 201 bp, Homo sapiens
ctgtggaaatgaggttgttgaggtccctgagattaaaagaaaagacacagtcatcaaaaccctgttggtggaggtaacatatttttgggagtccctaacamctgtaagaatgcaacaccgggcggtcactcttgagacaacaaagaaccattaatatcatgctcacacaatacatcctgtaagactaatggaatttcctgc

SEQ ID NO: 69427 - DNA, 201 bp, Homo sapiens
cgagtagctgggactacaggcgcccgccaccacgcccggctaatttttttgtatttttagtagagacggggtttcaccgtgttcaccaggatggtctcgayatcctgacctcatgatccgcccgcctcggcctcccaaagtgctgggattacaggcgatagctgctattcttattaggattctggaagtcacactctgtgt

SEQ ID NO: 69428 - DNA, 201 bp, Homo sapiens
gtacagtgacgtgatctcggctcactgcaagctccgcctcccgggttcacgccattctcctgcctcagcctcccgagtagctgggactacaggcgcccgcyaccacgcccggctaatttttttgtatttttagtagagacggggtttcaccgtgttcaccaggatggtctcgatatcctgacctcatgatccgcccgcctc

SEQ ID NO: 69429 - DNA, 201 bp, Homo sapiens
tgactgacattaccaacatagtcatatgaactgaatataagggtggcttaggaaatgcaggtgactgcaagatcacagaagtagggaaaacactggttgaygtttccttcatttcccacaggtggatttgagcttcagcccagcacaaagtcccccagcctcacatgcccacctgcaagtagcagctgctccgcagtccct

SEQ ID NO: 69430 - DNA, 201 bp, Homo sapiens
tcactctgtcactctgaaagcactggtgcaatcatagctcactgtagcctcaacctcgtgggcttaagtgatccttcttgcctcagcctcctgagtaactrctactacagccatgtgccacctggctaaattttttattttaatttttgtagagatgggggacctcacaatgttgtgcaggctgttctcaaactcctggcc

SEQ ID NO: 69431 - DNA, 201 bp, Homo sapiens
ggaaagtaagggtagtaaaataatataagaaaataatagtttttacttgcaaatttactctataaatggcctaaccctgcagatattgaatcatgaatcaytgaatcattaaagctttgaagagttacattttagtcacaatttactgattttactgatttggcatgggggcagggattttatccatctgttatggattca

SEQ ID NO: 69432 - DNA, 201 bp, Homo sapiens
aatgcaaacattcatgattgagtaaacatatattaaaacattttagcagctcactaccaatgacatcttgggcaagtttgtcaacctggatttgttctgayttcaatatctgttaaaaaaatattaactgaactcatataaaatagttctttagaatatcaaatatatgtggaattaatttttaatcgtgatatcttttag

SEQ ID NO: 69433 - DNA, 201 bp, Homo sapiens
ttttggatggaaggcactgaatatagagatattcgaaatatatagtgaagtgcaacttaacatgtattgtaggccatatatatatatacagaaagtatagytcctttatttttcaatcatgtatcaagtcttcaccaacagcccccagtgggggaccaaagcagggaaaataattttaaccctatccagttgtaagttggt

SEQ ID NO: 69434 - DNA, 201 bp, Homo sapiens
tcctcacctggatcacctgtattctccaaagccagcaggttggagtggcagagtcaaccaaactgcagagatggcagacacccctgccccccaggagctcrgtcccagggagagatcaaagctctgtctttagaaccctggctggagtacctgaagcccccacagaaaggtcccactcgatgaggaggaatggatcagggt

SEQ ID NO: 69435 - DNA, 201 bp, Homo sapiens
agcctgagtagacatagatgtttaacaggtggcaataataatatgtagctaaattcctcagggcattatgtattaattaaacacagatgcaagttacgtcktctttctatatttggtctatttttacctctagactctacaatgaagttttaattaatccttcataacttaagattttgttaatctttggaagcattttcc

SEQ ID NO: 69436 - DNA, 201 bp, Homo sapiens
tgatgagttacaattatctcctttttctcacccttaagacaacctcgtccattgggagcgccctcagagacccaaggcaccagtggggcatctttaccaamcccaggctccctctgctgaggtggagatgacatcctatgtgctcctcgcttatctcacggcccagccagcccccacctcaggggacctgacctctgcaac

SEQ ID NO: 69437 - DNA, 201 bp, Homo sapiens
gaagatgctggacttggtatctcttccactgcctctctccgagccttccagcccttctttgtggagctcacaatgccttactctgtgattcgtggagaggycttcacactcaaggccacggtcctaaactaccttcccaaatgcatccgggtaaggaaaatgagggtgaacaggaaaggtgggtagaacaaaagattcctt

SEQ ID NO: 69438 - DNA, 201 bp, Homo sapiens
ttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaag

SEQ ID NO: 69439 - DNA, 201 bp, Homo sapiens
tgagaacaacccacctgtcccagaaaacattgagagttaagttagcctgatccccttctgcttctctatagctttccccaacatttccccatcaattatgyctctgcttggatctctgagttaatgaccaagtctggttcagagagaatcactttcaatacggtaatcaagagtagtaactggtctctatacaatgtttgg

SEQ ID NO: 69440 - DNA, 201 bp, Homo sapiens
ttagaccaccatctgagtcttgagagtcagcacctgtcagctctgacctaactcagtttcctccactgtaaactgggagtgacaaactctacttctccatrttgtaccagattgtccagagatcaaagcatgtgatgataaagcaatttagaaatagaactgctagagtatataaataccaagtatagtaataactaactc

SEQ ID NO: 69441 - DNA, 201 bp, Homo sapiens
ctgctagagtatataaataccaagtatagtaataactaactcttaatttttttgtgagtaaattatctaaatacatcaacaactaaggtactagaaacaaraaaaggcaaaaatcaacatgaccaaataagatacacacatctaactacatcttacccgcagtctgaaagcaagtataaactatcagagtcttgccctgtc

SEQ ID NO: 69442 - DNA, 201 bp, Homo sapiens
tgtgggggttttgagtcacccatttgtctagacaccatggctagtgtaggaggcggtactgaaggggcgggggtcaaggctactagttcactgcttggagyattagcattcacattagccactgattcagctttttctggaaaacaaacacagattaagcaacagacatgagatgacatattgatccatctattagttgag

SEQ ID NO: 69443 - DNA, 201 bp, Homo sapiens
ttgctgaatcagtgaatggggctggatctgtgtgtaggtggctataggaacaatcccagaatacaacagagagaaaaaagagcagagaataataatcattytaaattaaaagtaaattcatttttccaaggtataacctagttttggaattatgcggtgaaaagaaatctagtcagtatgaaacttggacatcacttcgtc

SEQ ID NO: 69444 - DNA, 201 bp, Homo sapiens
ttttattcattttcacatccctaaaacacagcccagggcctgacactgcagaagcacttaatattcactgaaagaagagatacccacagagttaaagatgycaacgtcatcccacaaatgacttggattttacaaatcatcagcttagaccaccatctgagtcttgagagtcagcacctgtcagctctgacctaactcagt

SEQ ID NO: 69445 - DNA, 201 bp, Homo sapiens
atttactcctggtaaataatacaataaaaaagtaacaaaagggtttggggctggggatcatgtgaccaggttctcctcctgtttcctaatcctgtgactgraaagtcgtatcaccttttgaccttgttttctcatatgcaaaactaggagcagaatctttaccttattcacctcacaattactgaatcaaatgatattttg

SEQ ID NO: 69446 - DNA, 201 bp, Homo sapiens
aataaaaaagtaacaaaagggtttggggctggggatcatgtgaccaggttctcctcctgtttcctaatcctgtgactggaaagtcgtatcaccttttgacsttgttttctcatatgcaaaactaggagcagaatctttaccttattcacctcacaattactgaatcaaatgatattttgcaaaagaactgaacacagtaaa

SEQ ID NO: 69447 - DNA, 201 bp, Homo sapiens
ggtatagatttgcatttggaggtgcttttttcccctactgcaggactaggcaatttttatattatttcattagattatgagaacttctagagaaatggaakcatatacttaatggtgattattcttggccatagaatcacacgctgtcacattttgtctgggcctttgcttctcttggactgacagcactctaactggttt

SEQ ID NO: 69448 - DNA, 201 bp, Homo sapiens
gccacaggggttccagaaaagggaagtcactttaccttgcggtggtgggatcctgatgtctttcatccatttgtagtaaaagctggtaaagcttttcttaytcctggttccctaccagtatttctaaacatgtcgcactttctccacaggcatgtggttttgacctttttttcaatcttctagaaagggaacggaagcaga

SEQ ID NO: 69449 - DNA, 201 bp, Homo sapiens
atcctctgatgcttccatcttcctgtttaggccatgtgcccagaaacctggactgatctttctttaatagtgaacccctgggccactgaagagtaacatgrctccactggacacaaaagagggatggaatcaacaggcagggggccttttataagccttaggaaaagaaaatgaaactatttcatctttggacttttcaat

SEQ ID NO: 69450 - DNA, 201 bp, Homo sapiens
aaacctggactgatctttctttaatagtgaacccctgggccactgaagagtaacatggctccactggacacaaaagagggatggaatcaacaggcaggggsccttttataagccttaggaaaagaaaatgaaactatttcatctttggacttttcaatactattggagtgattttttttctttctaaacagggaaaataat

SEQ ID NO: 69451 - DNA, 201 bp, Homo sapiens
ctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagac

SEQ ID NO: 69452 - DNA, 201 bp, Homo sapiens
tttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagaca

SEQ ID NO: 69453 - DNA, 201 bp, Homo sapiens
gaaaaaaatatttaatatttttgttatataaggaatagtgcctaaggcaggtacttatactcctgacctcagccccacacactctggttttataaagctayaggacagagcagagatggaactgaaaaacagggtagaaaataacataaattggaggggaacagtgggatgcagaaagaatgacaacagccacatgtgccc

SEQ ID NO: 69454 - DNA, 201 bp, Homo sapiens
atcgacacaccctagcggtgaggcaccctgtgttgtataagccgagggaggagactgaaaggactgacctgaggttggggagaatatccagaggggacacratacgttgggatggacattagaaaactaggagctcagtttctctctgtgtcagacacgcatcttccatggaaaataggctgctgaaccaggaaggagcag

SEQ ID NO: 69455 - DNA, 201 bp, Homo sapiens
attcctctgcaatctcttggcagcctagaagaaatggtgagaacatgtaggtaatgccagatgataggagaagggaagctaaatgaaactgaggtctagcaatgattaattccaaagtacctgtcctaaattcagtaatatgaagtcagatggcaagctttaaaagcaaaatgaaattagaaagcaactggtatttaaaaa

SEQ ID NO: 69456 - DNA, 201 bp, Homo sapiens
atactggcaaaaagattctttgtgatatttttgtttaagggcccagaattcagacaaatagcaagaagggtagggtgattttcatttccgaaaaaaactctgtcaaaattgcatataggctgagtgcagtggctcacacctataatcccagcactttgggaagccaaggcagaaggatatcttgagcccaggactccaaga

SEQ ID NO: 69457 - DNA, 201 bp, Homo sapiens
ctgacctcaggtgatatgcctgccttggcctcccaaagtgctgggattacaggcatgagccactgtgccaggcctcatttctactttaaataaataggtaactactattttacaccgagtcctcaaacacatctccacgagtctccttcccccaaatgagtctctaaataaatgctcaccagcagatgggctgtccactcc

SEQ ID NO: 69458 - DNA, 201 bp, Homo sapiens
ggcttcttgaaactctttcatttttttcctcttcagccggaactgatggctacagctcacattgtacctacaggacagggcatatataggatgtcaatagygccacagaagaccaccctgctctaaatgtgaatttctgcttatgagctgatttggggaagggaataaaagcaaggagggagacataaaatatcagctatg

SEQ ID NO: 69459 - DNA, 201 bp, Homo sapiens
tgacctcaggtgatatgcctgccttggcctcccaaagtgctgggattacaggcatgagccactgtgccaggcctcatttctactttaaataaataggtaactactattttacaccgagtcctcaaacacatctccacgagtctccttcccccaaatgagtctctaaataaatgctcaccagcagatgggctgtccactccc

SEQ ID NO: 69460 - DNA, 201 bp, Homo sapiens
gacctcaggtgatatgcctgccttggcctcccaaagtgctgggattacaggcatgagccactgtgccaggcctcatttctactttaaataaataggtaactactattttacaccgagtcctcaaacacatctccacgagtctccttcccccaaatgagtctctaaataaatgctcaccagcagatgggctgtccactccca

SEQ ID NO: 69461 - DNA, 201 bp, Homo sapiens
ttctttcattaaatagttctgtgccttttacttttactggagtttgaaaagacaacaatcagaccaagtccccacttcaaagtcccaccttatggccctgycctcaccgggaaaggttctgctccttcctggataacaaagccttcaatgatgtgggtgagaatctggggcttcacgatggcctgtgggggttttgagtca

SEQ ID NO: 69462 - DNA, 201 bp, Homo sapiens
attttcacatccctaaaacacagcccagggcctgacactgcagaagcacttaatattcactgaaagaagagatacccacagagttaaagatgccaacgtcwtcccacaaatgacttggattttacaaatcatcagcttagaccaccatctgagtcttgagagtcagcacctgtcagctctgacctaactcagtttcctcca

SEQ ID NO: 69463 - DNA, 201 bp, Homo sapiens
ctagtcagtatgaaacttggacatcacttcgtccatactcttcccactcaatcagacattaccaactactactagtcttaaagatctcagagaaagaactyccttgctcagtcatttcagatcctgagtaatttcttgtgtctcttatctttgccatacttaaatattgtattcttttactctgtactcagcaaagaagaa

SEQ ID NO: 69464 - DNA, 201 bp, Homo sapiens
gcgcgagccgagaggccctggaagcgggactctgggaccccattgaaagaaaggcaaccagaaaaggcgaaacgacaacctcgatagtgattggagctgayggaacgagggcggagctaaagtcccagaatactggccaatcagagtttaagattatcagggagcccgggaaggggaaaggggcgaaatggttctatggtc

SEQ ID NO: 69465 - DNA, 201 bp, Homo sapiens
cagcctcttcctcagtcccccaaaccaaagctacacagccagatttctcaagcagtctcaactccagtccctcatctcacccttactattgctcttgcttyccagtttgcttttgatttgcatcttctcactagtaaaactgccttccctttgttccttattttctgttttttctctagagaggtacagttgtaagtcaga

SEQ ID NO: 69466 - DNA, 201 bp, Homo sapiens
ccttctaccacaaagatttccaaaagcagtgggaaaatcagtaagagtccttaagatagattataaaatctagaataaggagaactggaaattaaagatayaaatgtcctattttagatcatcttttggaaaaaaaaatttttttgagacagtctcactctgtcacccgggctggagtgccgtggtgctatcttggatcgc

SEQ ID NO: 69467 - DNA, 201 bp, Homo sapiens
ctaaaattattctcagggttcacccccaaaaacctacacaacctagttgagaatccctaaaacgcaaagttcaaaacctaaaatcacgaagacttgtcccktgagaactttatgacgtcttcctaaccttaagccgaactctctccattttagatgtcttactaattttatcctaattcatactcttagatttcagatatg

SEQ ID NO: 69468 - DNA, 201 bp, Homo sapiens
aaagctacacagccagatttctcaagcagtctcaactccagtccctcatctcacccttactattgctcttgctttccagtttgcttttgatttgcatcttytcactagtaaaactgccttccctttgttccttattttctgttttttctctagagaggtacagttgtaagtcagagttaatataatagggcctgtgaaaac

SEQ ID NO: 69469 - DNA, 201 bp, Homo sapiens
attaaaaaaaaaatgccaagaaacattatttatacagggttgattgctttcatgttgttattctgtaccctatagtagcctccatgagaatctggtatttyttgctgcttggaactactttgcagtgattacttggttgcagtccaagtactctcgtttagtctgagcctggagatgttctagacttgcttctcccacctc

SEQ ID NO: 69470 - DNA, 201 bp, Homo sapiens
ttatttatacagggttgattgctttcatgttgttattctgtaccctatagtagcctccatgagaatctggtatttcttgctgcttggaactactttgcagkgattacttggttgcagtccaagtactctcgtttagtctgagcctggagatgttctagacttgcttctcccacctctgagattaggacaggaaaaatgtga

SEQ ID NO: 69471 - DNA, 201 bp, Homo sapiens
ccgtttgttttttaaacacattttcacaagtttttgagacactggatttctttaattaaaaaaaaaatgccaagaaacattatttatacagggttgattgytttcatgttgttattctgtaccctatagtagcctccatgagaatctggtatttcttgctgcttggaactactttgcagtgattacttggttgcagtccaa

SEQ ID NO: 69472 - DNA, 201 bp, Homo sapiens
ctgtgtcagacacgcatcttccatggaaaataggctgctgaaccaggaaggagcagatgttttttgggttttttattttgttggacaggagtcaaaacacytaaccacctgaatgtgttatgccatctcatcatcaggacaattttaaccctgtgtctgaggagcgtggcaaagtccaagattgtttctacctctttgaga

SEQ ID NO: 69473 - DNA, 201 bp, Homo sapiens
catctttggacttttcaatactattggagtgattttttttctttctaaacagggaaaataatgttacaaaagcatcttttttgttatttgtttgcatcccycccccacaccctggtgttttaaaatgaagaaaaaaaaccatcactttttgtacaaaaactcttaatgattaaaaaacaaacaaaacatattggccttgtc

SEQ ID NO: 69474 - DNA, 201 bp, Homo sapiens
taaaaaacaaggtattgctggacagtcaccatgggtttctgctgcccctcaggcaatcattaggctcagagctggattctaaaattattctcagggttcacccccaaaaacctacacaacctagttgagaatccctaaaacgcaaagttcaaaacctaaaatcacgaagacttgtcccttgagaactttatgacgtcttcc

SEQ ID NO: 69475 - DNA, 201 bp, Homo sapiens
taaacagggaaaataatgttacaaaagcatcttttttgttatttgtttgcatccctcccccacaccctggtgttttaaaatgaagaaaaaaaaccatcacyttttgtacaaaaactcttaatgattaaaaaacaaacaaaacatattggccttgtcatttgtgtgaaagtgggcaaagactggaatagagtaagacaactg

SEQ ID NO: 69476 - DNA, 201 bp, Homo sapiens
ttttctcattatccctatagaaaaccaattcttgccacattcctagaccataagtacactttctcatatcctaaagttagatgctgcgaattatttccttyttttttctccccctacaggatggctgtgactttgtctgccgttctaaacctcgaaatgtgcctgcagcatatcgtggtgtgggggatgaccagctggggg

SEQ ID NO: 69477 - DNA, 201 bp, Homo sapiens
attatccctatagaaaaccaattcttgccacattcctagaccataagtacactttctcatatcctaaagttagatgctgcgaattatttccttcttttttytccccctacaggatggctgtgactttgtctgccgttctaaacctcgaaatgtgcctgcagcatatcgtggtgtgggggatgaccagctgggggaggagtc

SEQ ID NO: 69478 - DNA, 201 bp, Homo sapiens
gaggggaacagtgggatgcagaaagaatgacaacagccacatgtgccccagtcaaatacttttagtccctgcagcagaagatgccaaccaagtctctataytggctggggatcctgccatggatgcaggagaaaaaattcaatcacaagggagtaagtgacaacaaaaagaaaaaactctgagccacagctacactgggag

SEQ ID NO: 69479 - DNA, 201 bp, Homo sapiens
tgcagcagaagatgccaaccaagtctctatactggctggggatcctgccatggatgcaggagaaaaaattcaatcacaagggagtaagtgacaacaaaaaraaaaaactctgagccacagctacactgggaggggggaggaccagattttgctacttctgtcacacaagctagaaaaaccctacctctcccattgggcagg

SEQ ID NO: 69480 - DNA, 201 bp, Homo sapiens
cataataatctatgtccacccttgacaattcacctggattccctgtttttggatctattcatttgtccaccaacttctggcccattttctactcaaccagwtttatcttttagctcactcagaacattcctctactctgtgtgctctccaacagcattagaagtcagttactcacctccaagactgctcttctcgtccatg

SEQ ID NO: 69481 - DNA, 201 bp, Homo sapiens
tctactctgtgtgctctccaacagcattagaagtcagttactcacctccaagactgctcttctcgtccatgacttttgggctttctgctactggagatgcyttggcaggaagcattgaacccaatgtggagacatcatctctctcctcctcagagtcagccttgcgtttgacagccaatgtctggggtttaccctataccg

SEQ ID NO: 69482 - DNA, 201 bp, Homo sapiens
aagcgcttggaaagtcgggacactagacagagcgagaatttctggcaccctgggagagctttgagggggatgcgactgtggtgtggataagaatggctgayggacggattatcttgtgttcctcgttgtggggagcttccgctcttgggacatagccgctacttgtctgaggctccttctctcttgagttctttcagcatt

SEQ ID NO: 69483 - DNA, 201 bp, Homo sapiens
acagaagtgtagctatttccaagactggatccaagagaccagcttgtagaaatttaaggattatttgacacctacatataataggactttagaaatatcarataaacatatttaggccgacacatgtcattataagtgtcaggaaccttcagatatataaatctgaagttggtccctaagaaacgagactatccgatgaac

SEQ ID NO: 69484 - DNA, 201 bp, Homo sapiens
gtcacatgccgcggggtctggtgggaggagcggttgcccagcggcctcttggcgcttcctgtttccggttcccagagtggggcacagcgaggcgctagggrgaacgctggcctctgaaactagctctgggaccggggtctgcggccggcccctagctggccccgtctcccatccccagaagggtattcactggggattctg

SEQ ID NO: 69485 - DNA, 201 bp, Homo sapiens
aattgagagaaattgagtacaattgagtacaattaacaattgtactcaagtacagtgtaaggattaatggaaacatgaaccagtagttgggtaagaggtcyggagacaaagggggtcaggatctcttggaatttgtagtaatgcaatcaatgtgaaaccagagttctcatctcacaccctcttacctgggcaaatgaattg

SEQ ID NO: 69486 - DNA, 201 bp, Homo sapiens
tctgccaggacacagggctcacgcctgtaatcccagcactttgggaagccaaggcagatggatcacctaaggtcaggagtttgagaccaacctgaccaacrtgatgaaactccgtctctactaaaaatacaaaattagccagcacagtggcacatgcctgtaatcccagctacttgggaggctgaggcagtagaatcactt

SEQ ID NO: 69487 - DNA, 201 bp, Homo sapiens
cagcgaggcgctagggggaacgctggcctctgaaactagctctgggaccggggtctgcggccggcccctagctggccccgtctcccatccccagaagggtrttcactggggattctgagctttggctactccagtttcccacgacacgtgagtgtgaggggcgtggaggaggaggcgggctgggttgcgctcacacttaag

SEQ ID NO: 69488 - DNA, 201 bp, Homo sapiens
tgcatatgccagagaatcttgtactttctggataattaaaataccatcgatttattacacattcatacgctttatctctttcctctctctcctgatcctayctgccctccccaacacacactctctcccaaaggatgttccctttctacagctgctggaggactggactgctactactactcctggctgtggcagtgagag

SEQ ID NO: 69489 - DNA, 201 bp, Homo sapiens
tggggatcctgccatggatgcaggagaaaaaattcaatcacaagggagtaagtgacaacaaaaagaaaaaactctgagccacagctacactgggagggggraggaccagattttgctacttctgtcacacaagctagaaaaaccctacctctcccattgggcaggcaacctgacattccacccagttccttgccttaccat

SEQ ID NO: 69490 - DNA, 201 bp, Homo sapiens
tgccatcatgcccagctaatttttgtatttttagcagagacagggtttcacaatgttggccatgatggtcttgatctttgacctcgtgatctgcccacctyggcctcccaaggtgctgggattacaggcatgaaccaccgcgcccagccaactctagccagaattctgtagcctagagtccttttattcacccaaatactt

SEQ ID NO: 69491 - DNA, 201 bp, Homo sapiens
aggcatgaaccaccgcgcccagccaactctagccagaattctgtagcctagagtccttttattcacccaaatacttttaatgagtttcacactagacttamaaataccaaccaccaccaccacttttcatcaaattaatcaaagtttaccagttaaattttaagagctcaaacttttttttgcaaactactcagtctgcaa

SEQ ID NO: 69492 - DNA, 201 bp, Homo sapiens
aaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaa

SEQ ID NO: 69493 - DNA, 201 bp, Homo sapiens
ttagtttctaataccctgctccactgaaaaaaaaaattttttccccatgggaggtatcatagttaattacacaaaaacattttatccaaaaatttagtgaraaatgcagctacatcataagatgagaatcaaatactgtaaaattgctgacattacagaagataatgtcaacccagaaaaaaattaggaagtcaacttgaa

SEQ ID NO: 69494 - DNA, 201 bp, Homo sapiens
tagcattcaagctcctactgcttaaaagtcaattactttccctcttatcaaggcccctgtgggatgatgttaaggaaaacaacctgggttctgttgaagaragggtcagtaccttggagagaagcaataaactcgtacacctcctctacactccaacggctgggattactggacaggaacacagggttgatgccatgtaat

SEQ ID NO: 69495 - DNA, 201 bp, Homo sapiens
agaactgttgttttttcaaagactgatttggttaaggctatcttgatctaacttattacatacccaaaaacccagaatagtatcagcaacaaatttaggartataaagttcagatattatataatgtgtcactctcttacagaagaagcagataaataccaatattaaccctcttaactctttattcccctattcaattaa

SEQ ID NO: 69496 - DNA, 201 bp, Homo sapiens
ccaaccccaaagcctgtgcctgggctgtacctggctgtcgagtgcctacaacttgcacagggatatggggtggtggttgctgggcagctgacatcttagcrgcccctaactgaggcggcttgataggtgctacaggtggtttggattggatgggaattggtggcttaggggctgcatcaggtggaagagacaagggtgaag

SEQ ID NO: 69497 - DNA, 201 bp, Homo sapiens
gatttttcaagatcataaaatcctgctccttatttccaaagtatatagacaaactcttgtaccttgagaatctaattgtagcatattaaaagggggctacygggcccttccatttcattctcttcctgattgttgcacccctatgtttataagttttccagcagttatctttatgccacgaatcgtctaaattgccccagt

SEQ ID NO: 69498 - DNA, 201 bp, Homo sapiens
atgtgcccagaaacctggactgatctttctttaatagtgaacccctgggccactgaagagtaacatggctccactggacacaaaagagggatggaatcaayaggcagggggccttttataagccttaggaaaagaaaatgaaactatttcatctttggacttttcaatactattggagtgattttttttctttctaaacag

SEQ ID NO: 69499 - DNA, 201 bp, Homo sapiens
aaattttttccccatgggaggtatcatagttaattacacaaaaacattttatccaaaaatttagtgaaaaatgcagctacatcataagatgagaatcaaayactgtaaaattgctgacattacagaagataatgtcaacccagaaaaaaattaggaagtcaacttgaatattaggagtagagcctctatattagcattcaa

SEQ ID NO: 69500 - DNA, 201 bp, Homo sapiens
ctcctctacactccaacggctgggattactggacaggaacacagggttgatgccatgtaattccggtgtaggtggagctgtattgggattccccaggtcaygttctccatgcccagctcttactgataaaggcccaggagatgttggagagagtgcttcatcataactggaattatctgaaccccggctagagtcttcttg

SEQ ID NO: 69501 - DNA, 201 bp, Homo sapiens
tcttttttgttatttgtttgcatccctcccccacaccctggtgttttaaaatgaagaaaaaaaaccatcactttttgtacaaaaactcttaatgattaaamaacaaacaaaacatattggccttgtcatttgtgtgaaagtgggcaaagactggaatagagtaagacaactgaaaccaattttcatccttttactgaggaa

SEQ ID NO: 69502 - DNA, 201 bp, Homo sapiens
ccccttcctaccatcgattgactaactgatcccaagtcaatccctctgacaatcctgtatgtcttggccgtttctagtgtcttcagcatatcatacgtgtsgttcggcacacctgagactgtaatataccacaggatgcctaattccacagctcctctgtaagccacagctcaggacagttgtgcattaaaatcagtgaaa

SEQ ID NO: 69503 - DNA, 201 bp, Homo sapiens
cattgggcaggcaacctgacattccacccagttccttgccttaccatactatgtattcctcctcttggagaattaagacctgggctaaatgctccactccrggataaggctgagcagtcctagttctctagactgcctcttttataaagattggattaaggtacgtgaaatggtgagaactgtaaagattttaaaaaataa

SEQ ID NO: 69504 - DNA, 201 bp, Homo sapiens
gaatcacacgctgtcacattttgtctgggcctttgcttctcttggactgacagcactctaactggttttctaagagttaccagccccctttttcatttagwatcactactcatttttccttttcagggaatgtatcttaggaaacagctgacaataaatgcagaggttatcctatctgagtttttactatttcccagttct

SEQ ID NO: 69505 - DNA, 201 bp, Homo sapiens
cacacctgagactgtaatataccacaggatgcctaattccacagctcctctgtaagccacagctcaggacagttgtgcattaaaatcagtgaaaaacttaygcaaaatgaagactctagccagaattgttttgttttgttttgagacggagtctctctctgtcacccagcctggagtgcagtggcacaatctcggctcact

SEQ ID NO: 69506 - DNA, 201 bp, Homo sapiens
tggactgacagcactctaactggttttctaagagttaccagccccctttttcatttagtatcactactcatttttccttttcagggaatgtatcttaggaracagctgacaataaatgcagaggttatcctatctgagtttttactatttcccagttcttaagtatagatgtctttctctctctacaggtttgcatcactg

SEQ ID NO: 69507 - DNA, 201 bp, Homo sapiens
agctcaaacttttttttgcaaactactcagtctgcaaaactttacccactgatttttgtgctatggtggtgatatttcttaaaagtcatattgctggagakgaccatgtaagcacctatggtccaattccctcccatacagataaataagttatacaaggtagctatttactcctggtaaataatacaataaaaaagtaac

SEQ ID NO: 69508 - DNA, 201 bp, Homo sapiens
ggtttggattggatgggaattggtggcttaggggctgcatcaggtggaagagacaagggtgaagactgaagcatgggctgaacgaccagggtttgggcttkctgctgggactgggaaggtgggacctgctgagtaggtgggacctgtggtggctgaggggcagtgagggtggtggcttgcggctgctgctgttgctgctgt

SEQ ID NO: 69509 - DNA, 201 bp, Homo sapiens
gtgccacagaagaccaccctgctctaaatgtgaatttctgcttatgagctgatttggggaagggaataaaagcaaggagggagacataaaatatcagctakgagacgatcctggggaaggggtgtaacattagatggagataccagtgctgagggcaaggaggagggtgcccagagtacctcttagcgcaagtcatggagc

SEQ ID NO: 69510 - DNA, 201 bp, Homo sapiens
gactcacatcttcaacggaagtaagaaaactccccttcctaccatcgattgactaactgatcccaagtcaatccctctgacaatcctgtatgtcttggccktttctagtgtcttcagcatatcatacgtgtggttcggcacacctgagactgtaatataccacaggatgcctaattccacagctcctctgtaagccacagc

SEQ ID NO: 69511 - DNA, 201 bp, Homo sapiens
gggtatgaagatggataagagaaaagaaaatgttaggttttggtggggtttttttgccaaaaccacaatgacctttgcaccagtctagtaagtttgggaargagagctgtctgtgtgttttcattcctagagcagtacaagcagcaggtgcattgaatttactcaattgtaaagtggcttggtgatccccaatttgttgtc

SEQ ID NO: 69512 - DNA, 201 bp, Homo sapiens
ctgagctaataagtgtctggctgggcgcaggtgtggctgtccgtgtcaggttcatgcccacattctgctggccactcccatctgcttctgccttcttggcwgctgcactttctgcctctgtctggctgccctggctcacagtcactgtttgggctgcaggcaagggctgcaccactcctgtacccttcctgggacagctcc

SEQ ID NO: 69513 - DNA, 201 bp, Homo sapiens
gtaaagtgttttgcaagggtaagtcagtctgtcctgggtatgaagatggataagagaaaagaaaatgttaggttttggtggggtttttttgccaaaaccayaatgacctttgcaccagtctagtaagtttgggaaagagagctgtctgtgtgttttcattcctagagcagtacaagcagcaggtgcattgaatttactcaa

SEQ ID NO: 69514 - DNA, 201 bp, Homo sapiens
tgagctaataagtgtctggctgggcgcaggtgtggctgtccgtgtcaggttcatgcccacattctgctggccactcccatctgcttctgccttcttggctkctgcactttctgcctctgtctggctgccctggctcacagtcactgtttgggctgcaggcaagggctgcaccactcctgtacccttcctgggacagctccc

SEQ ID NO: 69515 - DNA, 201 bp, Homo sapiens
aggtcagtgtcaaaggtttattcctctctctttcttcccaaaccaccctgggttgggcgtagaagaaaaactcatcttatcatatgtgaaataagcagcaytttatttgcaaattcccaaaatctactctcaaagtctttcaaatagaaactgtatcacttccttgattctccccatgacctaacaattgatctagatttt

SEQ ID NO: 69516 - DNA, 201 bp, Homo sapiens
aaactctttcatttttttcctcttcagccggaactgatggctacagctcacattgtacctacaggacagggcatatataggatgtcaatagtgccacagargaccaccctgctctaaatgtgaatttctgcttatgagctgatttggggaagggaataaaagcaaggagggagacataaaatatcagctatgagacgatcc

SEQ ID NO: 69517 - DNA, 201 bp, Homo sapiens
gtgtgaggggcgtggaggaggaggcgggctgggttgcgctcacacttaagcgtctgtgacaggagccggaatcgcattctcccttgaccatggttctagcyaaagatctggctgaggagccctaagggtagaatggaggcggaggcatgagagcggagagtcacggagttccgaaaggtgtgagggagaaaggacttccaa

SEQ ID NO: 69518 - DNA, 201 bp, Homo sapiens; identical to SEQ ID NO: 38070

SEQ ID NO: 69519 - DNA, 201 bp, Homo sapiens; identical to SEQ ID NO: 38072

SEQ ID NO: 69520 - DNA, 201 bp, Homo sapiens; identical to SEQ ID NO: 38074

SEQ ID NO: 69521 - DNA, 201 bp, Homo sapiens; identical to SEQ ID NO: 39949

SEQ ID NO: 69522 - DNA, 201 bp, Homo sapiens; identical to SEQ ID NO: 39952

SEQ ID NO: 69523 - DNA, 201 bp, Homo sapiens; identical to SEQ ID NO: 40118

SEQ ID NO: 69524 - DNA, 201 bp, Homo sapiens; identical to SEQ ID NO: 40119

SEQ ID NO: 69525 - DNA, 201 bp, Homo sapiens; identical to SEQ ID NO: 40120

SEQ ID NO: 69526 - DNA, 201 bp, Homo sapiens; identical to SEQ ID NO: 40121

SEQ ID NO: 69527 - DNA, 201 bp, Homo sapiens; identical to SEQ ID NO: 40124

SEQ ID NO: 69528 - DNA, 201 bp, Homo sapiens; identical to SEQ ID NO: 41251

SEQ ID NO: 69529 - DNA, 201 bp, Homo sapiens; identical to SEQ ID NO: 39407

SEQ ID NO: 69530 - DNA, 201 bp, Homo sapiens; identical to SEQ ID NO: 40125

SEQ ID NO: 69531 - DNA, 201 bp, Homo sapiens; identical to SEQ ID NO: 41255

SEQ ID NO: 69532 - DNA, 201 bp, Homo sapiens; identical to SEQ ID NO: 39408

SEQ ID NO: 69533 - DNA, 201 bp, Homo sapiens; identical to SEQ ID NO: 40126

SEQ ID NO: 69534 - DNA, 201 bp, Homo sapiens; identical to SEQ ID NO: 39409

SEQ ID NO: 69535 - DNA, 201 bp, Homo sapiens; identical to SEQ ID NO: 41259

SEQ ID NO: 69536 - DNA, 201 bp, Homo sapiens; identical to SEQ ID NO: 40127

SEQ ID NO: 69537 - DNA, 201 bp, Homo sapiens; identical to SEQ ID NO: 39410

SEQ ID NO: 69538 - DNA, 201 bp, Homo sapiens; identical to SEQ ID NO: 40128

SEQ ID NO: 69539 - DNA, 201 bp, Homo sapiens; identical to SEQ ID NO: 41012

SEQ ID NO: 69540 - DNA, 201 bp, Homo sapiens; identical to SEQ ID NO: 41180

SEQ ID NO: 69541 - DNA, 201 bp, Homo sapiens; identical to SEQ ID NO: 38092

SEQ ID NO: 69542 - DNA, 201 bp, Homo sapiens; identical to SEQ ID NO: 40140

SEQ ID NO: 69543 - DNA, 201 bp, Homo sapiens; identical to SEQ ID NO: 40101

SEQ ID NO: 69544 - DNA, 201 bp, Homo sapiens; identical to SEQ ID NO: 40141

SEQ ID NO: 69545 - DNA, 201 bp, Homo sapiens; identical to SEQ ID NO: 40102

SEQ ID NO: 69546 - DNA, 201 bp, Homo sapiens; identical to SEQ ID NO: 41208

SEQ ID NO: 69547 - DNA, 201 bp, Homo sapiens; identical to SEQ ID NO: 40103

SEQ ID NO: 69548 - DNA, 201 bp, Homo sapiens; identical to SEQ ID NO: 41211

SEQ ID NO: 69549 - DNA, 201 bp, Homo sapiens; identical to SEQ ID NO: 40142

SEQ ID NO: 69550 - DNA, 201 bp, Homo sapiens; identical to SEQ ID NO: 40104

SEQ ID NO: 69551 - DNA, 201 bp, Homo sapiens; identical to SEQ ID NO: 40105

SEQ ID NO: 69552 - DNA, 201 bp, Homo sapiens; identical to SEQ ID NO: 40143

SEQ ID NO: 69553 - DNA, 201 bp, Homo sapiens; identical to SEQ ID NO: 40106

SEQ ID NO: 69554 - DNA, 201 bp, Homo sapiens; identical to SEQ ID NO: 41308

SEQ ID NO: 69555 - DNA, 201 bp, Homo sapiens; identical to SEQ ID NO: 41309

SEQ ID NO: 69556 - DNA, 201 bp, Homo sapiens; identical to SEQ ID NO: 41312

SEQ ID NO: 69557 - DNA, 201 bp, Homo sapiens; identical to SEQ ID NO: 47896

SEQ ID NO: 69558 - DNA, 201 bp, Homo sapiens
aactgggtatggctgctggaatgagggaggttacacagaaaatgctagaaaaagaaggggctttaacacatataaactagtgtttctcaaagtttcctctsaaagaggaaaaaaaatcaccttcaatgtttcaaaatttatctagtttgaaagcactaactaaaaatattaaaagacttctttgattgttataggtatgat

SEQ ID NO: 69559 - DNA, 201 bp, Homo sapiens
gggtgcccaagaaactgggtatggctgctggaatgagggaggttacacagaaaatgctagaaaaagaaggggctttaacacatataaactagtgtttctcmaagtttcctctgaaagaggaaaaaaaatcaccttcaatgtttcaaaatttatctagtttgaaagcactaactaaaaatattaaaagacttctttgattgt

SEQ ID NO: 69560 - DNA, 201 bp, Homo sapiens
acacggtgaaaccccgtctctacgaaaaatacaaaaaattaaccaagcgtggtggtgggcgtctgtagtcccagctacttgggaggctgaggcaggagaawggcgtgaacccgggaggcggagcttgcagtgagccgagatcgcgccactgcactccagcctgggcgacagagcaagactccgtctcaagaaaaaaagtaa

SEQ ID NO: 69561 - DNA, 201 bp, Homo sapiens
actcactgccttcgttgccgttctaagctaggggcgcagcccgaccgtcggactacatcccccaagtggacccttgagaaaacctggcagtcggccttgtvtgccgcgcacggctctccgggttttgtagtctcgtgtaggagtgatggggacgactccccactgttctcggccggggttggagttggggggtggggaccg

SEQ ID NO: 69562 - DNA, 201 bp, Homo sapiens
gagattttcagtgtgccctagttctttgctaaccaacttccagcatatttggttaccttcaaattgggctcatggtagaaagagcttagttgacctccccrgtgagaaatgctctatttgttcatgaacttgcagtacacactgttcctaggaagtggtacagagcaatctatgggaccaagaactaccttagacagtgca

SEQ ID NO: 69563 - DNA, 201 bp, Homo sapiens
aatctatgggaccaagaactaccttagacagtgcactatttttcatatcacagcagagaaatgttcaaggccactgagacttttattcctggaagaggatrtctgttgttgctcaaagccttggatctgagggaagacccttattgtctccaatttcctcctccaccttctccatcactctttacaaaggcactggaaaac

SEQ ID NO: 69564 - DNA, 201 bp, Homo sapiens
ccaagcgtggtggtgggcgtctgtagtcccagctacttgggaggctgaggcaggagaaaggcgtgaacccgggaggcggagcttgcagtgagccgagatcrcgccactgcactccagcctgggcgacagagcaagactccgtctcaagaaaaaaagtaatgcttccttcctctccaagaacaatagtttagaacgggctgt

SEQ ID NO: 69565 - DNA, 201 bp, Homo sapiens
ccctacccaggatttcagcacccaggtgtatgtaaccaggtcctatgtaggaaagctgttgacagtcatggccgtataccttcctcctccctgaccgcctrgggggcacagcactttaacccctggcctttttttgttttgttttgttttgttttttgagacggagtcttgttctgttgccaggctggagtgcagtggcgc

SEQ ID NO: 69566 - DNA, 201 bp, Homo sapiens
gataagctggagaagatcttccagaatgccccgacggaccctacccaggatttcagcacccaggtgtatgtaaccaggtcctatgtaggaaagctgttgasagtcatggccgtataccttcctcctccctgaccgcctggggggcacagcactttaacccctggcctttttttgttttgttttgttttgttttttgagacg

SEQ ID NO: 69567 - DNA, 201 bp, Homo sapiens
ccacgcccagctaaattttttttgtatttttagtagagacggggtttcatcatgttggccaggatggtctcgatctcctgacctcgtggtctgcccacctyggcctcccaaagtgctgggattacaggcgtgagccaccgtgcacggccaccactggcctattaggagcattcgggtgactgtcttctggacgtgttgtct

SEQ ID NO: 69568 - DNA, 201 bp, Homo sapiens
  misc_feature (1)...(201): n = A,T,C or G, or insertion/deletion polymorphism (see Tables 1-2)
gatggggcaagtgaggtgctggctcggaggagggacattgacctgttgtcattgctctactctccctcttcttccctatccttccaggtgttgaaggcggntttgaccttagcgaggagaagtttgaattagacgaggatgtgaagattgtcattttgccagattacctggagattgcccgggatggactggggggactgc

SEQ ID NO: 69569 - DNA, 201 bp, Homo sapiens
gcaccacccccagagcaaggacaaggagcccacttttctgggggatctggtgggagagagggtagggagcaggacaggaagggaagcttggaaatgaacamgacatggggatggccagaggagaagagagagagaccttggattggcggggggcctgcagagccctctctctctgccactccctcaaatccccgacccaca

SEQ ID NO: 69570 - DNA, 201 bp, Homo sapiens
agatcaagaccatcctggctaacacggtgaaaccccgtctctacgaaaaatacaaaaaattaaccaagcgtggtggtgggcgtctgtagtcccagctactwgggaggctgaggcaggagaaaggcgtgaacccgggaggcggagcttgcagtgagccgagatcgcgccactgcactccagcctgggcgacagagcaagact

SEQ ID NO: 69571 - DNA, 201 bp, Homo sapiens
ccccagaacttgttaaaaatgtaatgcttctgtttggccgggcgcggtggctcacgcctgtaatcccagcactttgggagggtgaggtgggcggatcacgmggtcagcagatcaagaccatcctggctaacacggtgaaaccccgtctctacgaaaaatacaaaaaattaaccaagcgtggtggtgggcgtctgtagtccc

SEQ ID NO: 69572 - DNA, 201 bp, Homo sapiens
aggtgggcggatcacgcggtcagcagatcaagaccatcctggctaacacggtgaaaccccgtctctacgaaaaatacaaaaaattaaccaagcgtggtggygggcgtctgtagtcccagctacttgggaggctgaggcaggagaaaggcgtgaacccgggaggcggagcttgcagtgagccgagatcgcgccactgcactc

SEQ ID NO: 69573 - DNA, 201 bp, Homo sapiens
tttatggtagatctaggaccagcatcctggcctcccaactcccaggcttagtattatttgtcttatactgggacccctaagatgggtgccgtgcttttagyagctcctctttacagagcagttctgacatagggggcaggggattgaggttcccgaatcactttccaggtaggcctccgggagctgctgaggtgacccttt

SEQ ID NO: 69574 - DNA, 201 bp, Homo sapiens
gggcgatggggagcgggtgccagaacagaaggtgcgtctaggaccctgtccctttcaggccctgggattgtggggaagctgaggtctgggagatgtctaargaaggcccctggatggccactgagccccagctgagtccctgccctgactcttcccaggaagttcaagatggcattgcccctcggatgttcaaggccctca

SEQ ID NO: 69575 - DNA, 201 bp, Homo sapiens
aaccggcagcaggatgcccaggagttcttccttcaccttatcaacatggtggaggtaagggctggcaagatggcacacccccatcttcctgcaatttactmgctctccttcctgcccatttctccctctatcagccccaacccagtcccatccctgaaccccaacagtctgtgtccctgtgaacagtgcttgcacctgagg

SEQ ID NO: 69576 - DNA, 201 bp, Homo sapiens
ccttcaccttatcaacatggtggaggtaagggctggcaagatggcacacccccatcttcctgcaatttactcgctctccttcctgcccatttctccctctrtcagccccaacccagtcccatccctgaaccccaacagtctgtgtccctgtgaacagtgcttgcacctgaggaggacagtgaaggtgatgatccctaccct

SEQ ID NO: 69577 - DNA, 201 bp, Homo sapiens
ttacagcgcccatgctggatgaatcagtcatcatccagctggtggagatgggattccctatggacgcctgccgcaaagctgtctactacacgggcaacagyggggctgaggccgccatgaactgggtcatgtcacacatggatgatccaggtaggctggggtggggagcagggtggggcagggcctccatcctcccccaaa

SEQ ID NO: 69578 - DNA, 201 bp, Homo sapiens
ggccacacagtgttagagaacagaacatttcttctggaacccagcagtttctgactccaggttttggtttcctcacctgaccaggcttcataacatcctcrtgttttcacccttacctcttgtcccacaggagtctgaggggggcctctacatctgtatgaacacgtttctgggctttgggaaacagtatgtggagagaca

SEQ ID NO: 69579 - DNA, 201 bp, Homo sapiens
aaaaatgtaatgcttctgtttggccgggcgcggtggctcacgcctgtaatcccagcactttgggagggtgaggtgggcggatcacgcggtcagcagatcargaccatcctggctaacacggtgaaaccccgtctctacgaaaaatacaaaaaattaaccaagcgtggtggtgggcgtctgtagtcccagctacttgggagg

SEQ ID NO: 69580 - DNA, 201 bp, Homo sapiens
actgctgggttttttgccccagaacttgttaaaaatgtaatgcttctgtttggccgggcgcggtggctcacgcctgtaatcccagcactttgggagggtgmggtgggcggatcacgcggtcagcagatcaagaccatcctggctaacacggtgaaaccccgtctctacgaaaaatacaaaaaattaaccaagcgtggtggt

SEQ ID NO: 69581 - DNA, 201 bp, Homo sapiens
tgttgccaggctggagtgcagtggcgcgatctcggctcactacaacctctgcctcctgggttcaagtgattctcctgcctcagtctcctgagtagctaggrctacaggcacatgccaccacgcccagctaaattttttttgtatttttagtagagacggggtttcatcatgttggccaggatggtctcgatctcctgacct

SEQ ID NO: 69582 - DNA, 201 bp, Homo sapiens
ttctgttgccaggctggagtgcagtggcgcgatctcggctcactacaacctctgcctcctgggttcaagtgattctcctgcctcagtctcctgagtagctrggactacaggcacatgccaccacgcccagctaaattttttttgtatttttagtagagacggggtttcatcatgttggccaggatggtctcgatctcctga

SEQ ID NO: 69583 - DNA, 201 bp, Homo sapiens
tttttttgttttgttttgttttgttttttgagacggagtcttgttctgttgccaggctggagtgcagtggcgcgatctcggctcactacaacctctgcctsctgggttcaagtgattctcctgcctcagtctcctgagtagctaggactacaggcacatgccaccacgcccagctaaattttttttgtatttttagtagag

SEQ ID NO: 69584 - DNA, 201 bp, Homo sapiens
gaggggcagcgatagactctggggatggagcaggacggggacgggaggggccggccacctgtctgtaaggagactttgttgcttcccctgcccccggaatycacagtgctctgcttctctgtgtcgccccgcccagccccctggtgtggagggaggggtctcgtttgtgcgcgtgggtgtagctttgtgcatcctctccca

SEQ ID NO: 69585 - DNA, 201 bp, Homo sapiens
gacatggagacaggctctggcccagtacctgcctcacattccctgaaactcctgtcctgagtctgagctgttgtctggatctttgggccatcactcaagcmttcctcttctgtttccttctctgaccccctctctcctttcctagagtatcagctctttgccttcattagtcacatgggcacctctaccatgtgtggtcac

SEQ ID NO: 69586 - DNA, 201 bp, Homo sapiens
taaggtgccaatccatgggagaaaaatgcatggaatgggtgattggaagagggctgggtcctgggggagggaggaggagcaaacagtggcccaatcagtckgtccgtgtacccacaattcccattacagcgcccatgctggatgaatcagtcatcatccagctggtggagatgggattccctatggacgcctgccgcaaag

SEQ ID NO: 69587 - DNA, 201 bp, Homo sapiens; identical to SEQ ID NO: 47912

SEQ ID NO: 69588 - DNA, 201 bp, Homo sapiens
tcctaatgaagtgttccgcttcttggtggaggaaaagatcaagtgcctggccacagagaaggtgaagtacacccagcgagttgactacatcatgcagctgyctgtgcccatggatgcagcccttaacaaaggtaggctgctccatcagcaaggccgtggcacggtgggaggctaaggtctaggaggaatgcttgggcacct

SEQ ID NO: 69589 - DNA, 201 bp, Homo sapiens
cctccgggagctgctgaggtgacccttttcccacagatgtgtccatcgagatgccagaggagctcgacatctcccagttgaggggcacagggctgcagccyggagaggaggagctgccagacattgccccacccctggtcactccggatgagcccaaaggtagccttggtttctatggcaacgaagacgaagactccttct

SEQ ID NO: 69590 - DNA, 201 bp, Homo sapiens
tctggcccttgccagaaaaagtttaccaaccccctgcctccctggaatgggtggagggtggttgtaaaggtactggaggatctgaagacataatagggtcygtgacccttgtgaggttgtgaagctcccttaaggcacatggtggctgggctgtggatttggggtatgggcagagagtgtggagagcacttccaggggcca

SEQ ID NO: 69591 - DNA, 201 bp, Homo sapiens
cctccccggtgagaaatgctctatttgttcatgaacttgcagtacacactgttcctaggaagtggtacagagcaatctatgggaccaagaactaccttagmcagtgcactatttttcatatcacagcagagaaatgttcaaggccactgagacttttattcctggaagaggatgtctgttgttgctcaaagccttggatct

SEQ ID NO: 69592 - DNA, 201 bp, Homo sapiens; identical to SEQ ID NO: 47919

SEQ ID NO: 69593 - DNA, 201 bp, Homo sapiens
gaaccaatcccactcctccagggcgggagcgcacgtagagcagctaggtgggcttcggggttgcagctgctgcggctccgcagctgctccggctccgggayccttagagtccattcgcgtgccttctattgaagagcaggaactgacggttgttttaggcctctcaattccagaaagtttcctggggacctgtccggtcgg

SEQ ID NO: 69594 - DNA, 201 bp, Homo sapiens
aatgtctgaattcttgggtctcttcctaacctgattttgagagagccgtcatgaccccacccttatcctagccttattttctgcaatctcaatctgtgtgrggtaggctggatatctgagggccttggcaattccttcctggaatatggggaggagaggagagaagagtcagggcccagacttgttctagcctatggtctt

SEQ ID NO: 69595 - DNA, 201 bp, Homo sapiens
gcggccttcacccctaagtgaaaatgttagtgaactaaaggaaggagccattcttggaactggacgacttctgaaaactggaggacgagcatgggagcaargccaggaccatgacaaggaaaatcagcactttcccttggtggagagctaggccctgcatggccccagcaatgcagtcacccagggcctggtgatatctgt

SEQ ID NO: 69596 - DNA, 201 bp, Homo sapiens
gcaatctcaatctgtgtggggtaggctggatatctgagggccttggcaattccttcctggaatatggggaggagaggagagaagagtcagggcccagactygttctagcctatggtcttgacaggtggagagctctccacagccaggcctaccagcaggggagcaactggagggtcttaaacatgcccaggactcagatcc

SEQ ID NO: 69597 - DNA, 201 bp, Homo sapiens
ctaccaaactgggactcacagctttattgggctttctttgtgtcttgtgtgtttcttttatattaaaggaagtaattttaaatgttactttaaaaaggtawatgtaaaccttgcaccgagttttctgtgtgtagaatggcggcctagagagcttgcgttccctggcctgagcccactgatgctctgagccttctttgcaca

SEQ ID NO: 69598 - DNA, 201 bp, Homo sapiens
aagagcaggaactgacggttgttttaggcctctcaattccagaaagtttcctggggacctgtccggtcggaaagtcgagggacagttgtcttggtatttgwaaagggggtatccagtgaggcggagcttgagggggttgtgtcgagtgactgatacagctgtcaaccaataaagctactatcgctcgcctcaggaaaacca

SEQ ID NO: 69599 - DNA, 201 bp, Homo sapiens
cggcctcccaaagtgctgggattacaggcatgagccaccgcacccggcctgtgcactttatttctattattattacattataatatataatgaaataattwtacatctcaccataatgtagaatcagtgggagccatgaacttgttttccgcaactagacggtcccatctgggggtgatgggagatagtgacagatcatca

SEQ ID NO: 69600 - DNA, 201 bp, Homo sapiens
atggcctctgcagcacacgcagctggagagggcttctgtccctgtcagcggcagagggcgttggggctggccggggcaccttgtccctgctatggtccacrtgctcacgctgtccacctgccaggtggagtgtatgtggctgtggccctccctcgtggaggtgccgtgctttaaagaggccttagtgcccgggatgggcac

SEQ ID NO: 69601 - DNA, 201 bp, Homo sapiens
aaagccaaggcccagagtggtgggcgggaggcagttcttccccaccgctcctcacctctctctgtctcctcccgtcccacccccaagtctgttcacacagygagcctgcagttttcaaggtggcttgtcaaggacatctcctgacatgcacgttcacctcctgaccttgttcctgctgtaaatttgtgaattaagtgggga

SEQ ID NO: 69602 - DNA, 201 bp, Homo sapiens
tgacccactctgttgatacactatgtgtcctgcagatgcttttacagggttaaatgataccacaagaggcagggcagcgggctcgacgagctctgttctgrtgcgggcaggaggcgggagcccggatctgtgcgactgaaggtgggagactgggccgggtggacctggtggtctggtgtgggcaggaggtgggcaatgagg

SEQ ID NO: 69603 - DNA, 201 bp, Homo sapiens
ggcagtttaaaaactggcaaggaacagaagggttgtgggggcagatttttatctaaagtcagggccatgatttgtgcatttgaccctgtgtaagttacacygcaacaagaaagtgaatttttaaaaatcacaaaaatactgcagatagacataaagccaaggccctagagtcagggtgctggaggctcagcagcttctctc

SEQ ID NO: 69604 - DNA, 201 bp, Homo sapiens
ctggagtgatcctcccaccccagccttctgagtagctgggcccacaggtgtgtgccaccatacccagctaatttttatttgtatttttttgtagagatggkgtctccctgtgtttcccaggcaggtcttaaactcttgggcttaagtgatcctcctgcctcggcctcccaaagtactagaattagagacatgagccatgtg

SEQ ID NO: 69605 - DNA, 201 bp, Homo sapiens
tgtggatgaagatttggctgtctgagaggagcccggccccaaggggcaagggaaagggatgtgatgccaggagtgctggctgtataccaagtggattcctyagatggctgataaccaagccgataggacaggagtgagagcagaggtagtgtcttgcagactccaacccaagccttgaggagggagcgggtgactgacagg

SEQ ID NO: 69606 - DNA, 201 bp, Homo sapiens
aagcgcttcgtagccccggaagcgcttaggcatctccgaagtagcgctgggcaaagtgaaggcttcctgatctcagaagcacgttgtgggcttggaaacckacggcagcctttagtcaattttggatcgctttgacttctccaacacggtttggcatctctgaaaccttgagaactgtgatgggcagtggaaagaagaggg

SEQ ID NO: 69607 - DNA, 201 bp, Homo sapiens
acctggataaccagagaagaagggaaggatgtcattggacggaaactagtgatttttaacatagcttataattgaggggaagcattcctccatctttttctttttttttttttttttgttgttgggacagagtcttgctctgttgcccaggctggagtgcgatggtgcaatcttggctcactgcaacctccacctcctggg

SEQ ID NO: 69608 - DNA, 201 bp, Homo sapiens
ctctgtggaatcttgtagaatatattttgatctcagggctctgaaatttcatggtggtggtgtctactttgcttagcatgggacattccctttcaatctaraaacccttgtactttagctgtgggaaaagttcgtgaattactgtacttcgctgatgttttctttccgtatttttcttctctctttctctctctagcttct

SEQ ID NO: 69609 - DNA, 201 bp, Homo sapiens
cagtttgactgtcactgttctggtgtcaactccagcgtcggcacaggcagaaggacttcagctgctggtctcattggttccactgccattgatatgggggrgtgcagaggagcactcattgtccatgatggagatccaggacagactgggggactccgggaagaggctttcttggggaagaggaccccaaaggaggtactt

SEQ ID NO: 69610 - DNA, 201 bp, Homo sapiens
ttctaggtgtttgggattctttactaacaaaacagatcactttccccttagagtttgcatcctagattttgaaggtctgagtcttaagaagtgagaagttytgcctgtggaggagtggagaaacagtcttatttgggatcagatgggctgcctctagagaaaattactttacaaaagcaattaaaacaggccctaaggaat

SEQ ID NO: 69611 - DNA, 201 bp, Homo sapiens
ttgctgttcattttgtgtgctttccccttgtaggtttataccttttcggatatatttcctgtaactttagaagggtttttgggtgggaaggacaaaaactrtatgctatatatataattggaaattcccacataaagtaggtttgtaagatattttcctcccaaatatgtaatgggtgtgttttctgtctaatgtagatca

SEQ ID NO: 69612 - DNA, 201 bp, Homo sapiens
tttcctgcatctccacttggcacatgtctagtgcacacgtggaacaccaggcttggggctgttgttgccaaggacaatcgggccatgcttcacagactgaraagtcactcaccacggggcagtgagtggagagctgtaacagggatgggtttggagtacccaagggtcaggggaatgagcgactgaccatcaggaaggtcc

SEQ ID NO: 69613 - DNA, 201 bp, Homo sapiens
acagtaaagcactgggtattgaggctcttgagtgatagagcttttgcacatcccctttcctgcatctccacttggcacatgtctagtgcacacgtggaacrccaggcttggggctgttgttgccaaggacaatcgggccatgcttcacagactgagaagtcactcaccacggggcagtgagtggagagctgtaacagggat

SEQ ID NO: 69614 - DNA, 201 bp, Homo sapiens
ctctttctacttccctgcattccccaaagagatccattataaacagtttagctttttagacttgtttgcgaatatatacatataaagcaattttgcctttytttttttgagatagggtctcactgtattgcctaggctggagtgcagtggtgccgtcacggctcactgaaacctctgcctcccaggttcaagcgattcttg

SEQ ID NO: 69615 - DNA, 201 bp, Homo sapiens
tccaacttcaaagccagtgttctctgcactgctgcctctgggagcacctgctctgttctagcctggcatcagatgtaggggtggcaagacgaaggtgccarggtccctcccttgcggagctctctgcagggtgagttagcccaggcacagtaaagcactgggtattgaggctcttgagtgatagagcttttgcacatcccc

SEQ ID NO: 69616 - DNA, 201 bp, Homo sapiens
aggaccagccaggagtgaaggaccagccaagactgcagaaggagcagccaggagtgtcacagtcactgctgctcagaaggagaaagacgcaaccccagagrtcagcatggaggaggataagacagtgccagagaggagcagcttctatgacaggagagtagttatagaccctcaagagaaacccagtgaggagccccttgg

SEQ ID NO: 69617 - DNA, 201 bp, Homo sapiens
ttggggaccgaaggactgtcattgacaaatgctctccacccctagagttcttggatgactctgactctcatttagaaatccaaaaggtgagtaaagcttgyaccaggcatctgactttttagttctgttgatgaaatgtgttccatctttctagtttgatcctaagtgttactaattaaaaatagtactttacttaaccag

SEQ ID NO: 69618 - DNA, 201 bp, Homo sapiens
accaggcctccaggaaacaaactgatggttttcttctaacatacttttcagattttcagagttattaataaacctaaactaagtgcttttttttttttttraaggatttatatgttaggatatgggtttagctgctgtgtaaaaggccaaaatcacagtggcttaaacagaatataagtttggcttaagaaggatggctcc

SEQ ID NO: 69619 - DNA, 201 bp, Homo sapiens
gagcaagaccctgtctgaaaaaaaaatacaactgccacagctgttgtaattttacattttgaatatattgacgacagtgtcagagaggaaaagctgggcastgcttttctctaaaatctccaatccggagtgtgttctagagagcagtttttctcaagagaaagggatgcaggtagagcaccacctttaggagtagcatga

SEQ ID NO: 69620 - DNA, 201 bp, Homo sapiens
caagaccctgtctgaaaaaaaaatacaactgccacagctgttgtaattttacattttgaatatattgacgacagtgtcagagaggaaaagctgggcactgyttttctctaaaatctccaatccggagtgtgttctagagagcagtttttctcaagagaaagggatgcaggtagagcaccacctttaggagtagcatgatga

SEQ ID NO: 69621 - DNA, 201 bp, Homo sapiens
tttggttgtctgtttatgatcaagaatgggaggattaaaaagctgtttggaagctctgagcgtaaagactttgagctttgctttgggatgatcgggagaayataaccctcttccccttgccatgtcactgcttttaggaaagcctcgagactggtcaccttgcccagaggagtgtttttcagcctgcttaggaggaaaggt

SEQ ID NO: 69622 - DNA, 201 bp, Homo sapiens
gagggagaagtactttgtgacttcttatggatgatatcaatgtcaaaacatttgttttctttctttcttgggaagcaataaactttaggttttcttaattkattttttgagagggagtcttgctcttttgcccaggctttggagtgcagtggtgcgatctcagctcgctgcaacctccgcctcctgggttcaaactgtttt

SEQ ID NO: 69623 - DNA, 201 bp, Homo sapiens
gcgtctccaaaagtttggagcgtctccacaggctggagtgcagtggcacaagctcggcttactgtgaccttgaccttccacactcaagcaatccttctgtstcagctcctggagtagctgggactacaggtgtgggtcactgcacccagctaatttttgtatttttcttgtacagatggggtcttgctatgttgcccagac

SEQ ID NO: 69624 - DNA, 201 bp, Homo sapiens
tggctcactgcaacttctgcctcccaggttcaagtgattctcatgtctcagcctcccgagcagctggggttacaggcgtgcacaaccgcatttggctagtkttttgtatctttagtagagatggggttttgccatgttgcccaggctggtctggaattcctcagctcaagtggtctgcctgctttggcctcccaaagtgct

SEQ ID NO: 69625 - DNA, 201 bp, Homo sapiens
atgcctgtaatcccaactactcaggaggctgaggcaggagaatcacttgaacctgagaggcggaggttgtaagtgagctgagatggcgccactgtactccrgcctgggcgacagagtgagactgtctcagaaaatagaatttatgactccagtctaagtccctaccttgaactgaagaattgaatgacatcacctccccat

SEQ ID NO: 69626 - DNA, 201 bp, Homo sapiens
gttcaagtgattctcctggctcagcctcctgagtagctgggattacaggtgcctgccaccacacccggctaatttttttttttttttaaggcagagtttcrctcttgttggccaggctggagtgcaatcgcatgatattggctcactgcagcctccagttcccaggttcaagcgattctcttgcctcagcctcctgagtag

SEQ ID NO: 69627 - DNA, 201 bp, Homo sapiens
tttttttttttttttaaggcagagtttcactcttgttggccaggctggagtgcaatcgcatgatattggctcactgcagcctccagttcccaggttcaagygattctcttgcctcagcctcctgagtagctgggattatagactcccgccaccacgcccagctaattttttgtatttacaggatcacacctgtaatcccag

SEQ ID NO: 69628 - DNA, 201 bp, Homo sapiens
gtgtgtaaaatgggctagctcttcaaatgttaccacttgtaaaaagctaatacagggtcagatgcatttttgggtttacagcctctgttgcagcttttcarctctgcatgaaaatggccatagacaacgtacaagtgaatgggcctgactgtattccaataaaaccttatttacaccagcaggcagtgtgttgttcagtga

SEQ ID NO: 69629 - DNA, 201 bp, Homo sapiens
caggcggatcacctgaggccaggagttggagaccagcctggccaacgtggcgaaaccccgtctctattaaaaatacaaaaattagctgggtatagctgggygtggtgactcatgcctgtaatcccagcactttgggaggccaaggcgagcggatcacctgaggccaggagttggagaccagcctggccaacatggtgaaac

SEQ ID NO: 69630 - DNA, 201 bp, Homo sapiens
ctcagggctgctgtgtgggtgtgttaagctgataaggttcagtttgcggcggaaactacctgctagtcttgtgtcaggggctgccagcctccttttgtttyacttttgcccccttcttgggaacatttgaccaaaaataatcctcatttcatcttgtgtacagtcctttgtgtaccccgcccaggttgagaggtgaatcag

SEQ ID NO: 69631 - DNA, 201 bp, Homo sapiens
tgaggccaggagttggagaccagcctggccaacatggtgaaaccctatctctaccaaaaaaaaaaaaaaaaattagctgggtgtgatggtacatgcctggsgtcccagctactcaggaggctgaggcaggaggattgcttgagcctgggaggttgagctgcagtgacccatgattatgctccagcctgggtgacagagtga

SEQ ID NO: 69632 - DNA, 201 bp, Homo sapiens
gtttggaaccttcttctttttctcttccaccctccagggcgaccagcagcctgacagaacacaggctggcttgaagtctgtgtctcaggtcgaggatgtgwttagagagctgattggaacacagaaaaccaggacaggatgttttcctccaagcgggtcataaggcttcagcttctgggtggtgggtggggtggggtgggc

SEQ ID NO: 69633 - DNA, 201 bp, Homo sapiens
ctgtattttttaaaaaccaggacaagtcttttgttgcattttgttaatgtaaagaatataaacatagtatgagcattaagcctgatttgttttgagtgacrtggtttggaaccttcttctttttctcttccaccctccagggcgaccagcagcctgacagaacacaggctggcttgaagtctgtgtctcaggtcgaggatg

SEQ ID NO: 69634 - DNA, 201 bp, Homo sapiens
agtttttgaaggattgttctcccttatagataagtttttaaaggttttaggggaaattgcaaacattcaaagtaaacagaatagtgtattgaatcaccagrtgcccatcacccagcttcaagagttcagattaaattaaaaatgtgctacatttaagttagcttgcattttagaaaagattcttgtttggatatttctgcc

SEQ ID NO: 69635 - DNA, 201 bp, Homo sapiens
ctgactttttagttctgttgatgaaatgtgttccatctttctagtttgatcctaagtgttactaattaaaaatagtactttacttaaccaggcctccaggraacaaactgatggttttcttctaacatacttttcagattttcagagttattaataaacctaaactaagtgcttttttttttttttgaaggatttatatgt

SEQ ID NO: 69636 - DNA, 201 bp, Homo sapiens
ttgcagctgaagctgagggtcagaatgatacaattgaggaacccaacaaggtccagaaaaggaagagggatagacttcgagaccagggctccacaatgatytacctgaaggctatccagggcatcctggggaaatcgatgccaaaaaggaagggagaggctgccactcgggcaaaaccaagcgcagcagagcatcccagcc

SEQ ID NO: 69637 - DNA, 201 bp, Homo sapiens
gattcagaaaggttaaataagctgaccaaggccatgcagctggtaaatggccgagctgtggggtaatatcagattagtccaacttcaaagccagtgttctytgcactgctgcctctgggagcacctgctctgttctagcctggcatcagatgtaggggtggcaagacgaaggtgccagggtccctcccttgcggagctctc

SEQ ID NO: 69638 - DNA, 201 bp, Homo sapiens
atgtgctcaagagaagaatgtatttattttagttgtcagtttaaagaattgtgtgcccttgtactttgaaccactctgaatcacagaaccaagaattgcgsttcttggtgtagcttttctccaaagtcatagtttccagcatgttggggttttgcttggtggtgctagttttttttttttttcttttttttttggaggtta

SEQ ID NO: 69639 - DNA, 201 bp, Homo sapiens
tgaggctcttgagtgatagagcttttgcacatcccctttcctgcatctccacttggcacatgtctagtgcacacgtggaacaccaggcttggggctgttgktgccaaggacaatcgggccatgcttcacagactgagaagtcactcaccacggggcagtgagtggagagctgtaacagggatgggtttggagtacccaagg

SEQ ID NO: 69640 - DNA, 201 bp, Homo sapiens
accagggctccacaatgatctacctgaaggctatccagggcatcctggggaaatcgatgccaaaaaggaagggagaggctgccactcgggcaaaaccaagygcagcagagcatcccagccatggagaaggaccagccaggagtgaaggaccagccaagactgcagaaggagcagccaggagtgtcacagtcactgctgctc

SEQ ID NO: 69641 - DNA, 201 bp, Homo sapiens
ttcactgtgttagccaggatggtctcgatgggcccgcctcggcctcccaaagtgctgggattacagacattagccaccgcgcccagctaggtttatgattsttttaagttttattttcctttggcccttgattcaggataatgattaaaaaaaaatatgatgtgctcttcggaaaaaaatttcaaatgatacaagaagctt

SEQ ID NO: 69642 - DNA, 201 bp, Homo sapiens
tttggcacccaaatgaggtgaatggtggtgactggcaactgcacctagttggatgtcagtgctgagttgcatttacctaaaagagcagttagcaagttctkgatgtgtcctgctgaatgttttatcttgtgaagggaagaagaagaacctatagagggctgggcgaggtggctcacgcctgtaatcccaacactttgggag

SEQ ID NO: 69643 - DNA, 201 bp, Homo sapiens
acaatgatctacctgaaggctatccagggcatcctggggaaatcgatgccaaaaaggaagggagaggctgccactcgggcaaaaccaagcgcagcagagcrtcccagccatggagaaggaccagccaggagtgaaggaccagccaagactgcagaaggagcagccaggagtgtcacagtcactgctgctcagaaggagaaa

SEQ ID NO: 69644 - DNA, 201 bp, Homo sapiens
tgtctgtggtcattttcctttctttgaaaacacagattaaacaaaagttacatcagaattggtattggcttagtgttgctattttgagaagaggcagtacrggtgttagacttgtaaatattctcaagtgaatatcacctgactcaaattacaaaaagtatctcattgtttgatgctgaaaacataaacacaaattatgtt

SEQ ID NO: 69645 - DNA, 201 bp, Homo sapiens
attgtttgatgctgaaaacataaacacaaattatgttccacagttgtagaaactactcatggaaacattaatatgaggtaatttgcttataatgaattaattttttttttttttttttggagacagtcttgctctgtccaggctggagtgcagtggcatgatctcagctcactgcagcctttgcctcccaggttcagggga

SEQ ID NO: 69646 - DNA, 201 bp, Homo sapiens
ttataatgaattaattttttttttttttttttggagacagtcttgctctgtccaggctggagtgcagtggcatgatctcagctcactgcagcctttgcctsccaggttcaggggattctcctgcctcagccacccaagtagctgggattataggcacctgccaccacacccagctaatttttgtatttttagtagagacag

SEQ ID NO: 69647 - DNA, 201 bp, Homo sapiens
cggggagagttaaatgcagattccttggccccaccttggacctattgaatcacaatatctcagggtggaatgggccttaaaaatctgtttttaaaatgctrcccagttgatggagatgtgatgctaagttgaggcaccatttattctaaaaattaattcagcagatattcatgagcactcagtatctgccaggcactgttc

SEQ ID NO: 69648 - DNA, 201 bp, Homo sapiens
atcccagcactttgggaggctgaggcgggcagatcagttgaggttagtttgagaccagcctgaccaacatggcgaaaccccatctctacaaacaaatacaraaattagccaggcaaggtggtgcctgcctgtaataccagctacgcgggaggctgaggcaggagaatcgcttgaacccaggaggtggaggctgaagtgagc

SEQ ID NO: 69649 - DNA, 201 bp, Homo sapiens
acccaggaggtggaggctgaagtgagctgcaattgcaccactacactccagcctgggcgacagagcaagattcggtctcaaaaaaacaaaacaaaacaaaacaaaaaaaaaaaagcaagttgtagaaaataagtgtagtatttgtttctttaacaaatatttgagtaccttctgagagccaggcaccttgctggagatgca

SEQ ID NO: 69650 - DNA, 201 bp, Homo sapiens; identical to SEQ ID NO: 29478

SEQ ID NO: 69651 - DNA, 201 bp, Homo sapiens
gccttgcgtgagaacaccagtcgcctctacagtctttaagcagagaaggtacagtcctcgggagtctcctagaaaaggtcgtaaaactcacattctgtatkttttaaaaaccaggacaagtcttttgttgcattttgttaatgtaaagaatataaacatagtatgagcattaagcctgatttgttttgagtgacatggttt

SEQ ID NO: 69652 - DNA, 201 bp, Homo sapiens
cccaggaggtggaggctgaagtgagctgcaattgcaccactacactccagcctgggcgacagagcaagattcggtctcaaaaaaacaaaacaaaacaaaacaaaaaaaaaaaagcaagttgtagaaaataagtgtagtatttgtttctttaacaaatatttgagtaccttctgagagccaggcaccttgctggagatgcac

SEQ ID NO: 69653 - DNA, 201 bp, Homo sapiens
ccaggaggtggaggctgaagtgagctgcaattgcaccactacactccagcctgggcgacagagcaagattcggtctcaaaaaaacaaaacaaaacaaaacaaaaaaaaaaaagcaagttgtagaaaataagtgtagtatttgtttctttaacaaatatttgagtaccttctgagagccaggcaccttgctggagatgcaca

SEQ ID NO: 69654 - DNA, 201 bp, Homo sapiens
gcagctccttccctaaggaatttcagggctgcatctctgacttctgtgatccccgcaccctgacagattgcctatgggaggagctgttgaaagaggatctrgtctggggggcctttggctgtcaccctcattttgcacgttactacagtgagagtcaagaaagaaatcttttgcaagccttaaggcaccctaaggctgtgg

SEQ ID NO: 69655 - DNA, 201 bp, Homo sapiens
gccagctattggaccagcagccccaagccttctagctacccctccacaggcagcagcagcaacgatgcagcccaggttgggaagagcagccggagccgcaygagtgattattcccccaactctacagggagtgtccaaaacacctccagagacatggaggcctcagaggaaggctggtcccagaattctcgttcatttcgc

SEQ ID NO: 69656 - DNA, 201 bp, Homo sapiens
agtagctgggattaccggcacatgccaccacgcccagctagtttttgtattttaagtagagacggggttttgccatgttggccaggctggtcccgaactcstgacctcgtgatctgcctgcctcggcctcccaaagtgctgggattataggcgtgagccaccgtgcccggcctatacactatcttttctaaagaattaact

SEQ ID NO: 69657 - DNA, 201 bp, Homo sapiens
tttgtattttaagtagagacggggttttgccatgttggccaggctggtcccgaactcctgacctcgtgatctgcctgcctcggcctcccaaagtgctgggrttataggcgtgagccaccgtgcccggcctatacactatcttttctaaagaattaactattaggttaaaccacttgaaatttctcatatttgacctttttt

SEQ ID NO: 69658 - DNA, 201 bp, Homo sapiens
tcatggctaatactctgttaatatttttttctttttctttttggagacagaatctcactctgtcacccaggctggagggcagtggcacgatctcggctcaytgcggcctccacctccgcctccgcctccgcctcctgggttcaagcgattctcctgcctcagcctcccgagtagctgagactgcaggtgtgtgccaccttg

SEQ ID NO: 69659 - DNA, 201 bp, Homo sapiens
ccaggctggagtgcaatcgcatgatattggctcactgcagcctccagttcccaggttcaagcgattctcttgcctcagcctcctgagtagctgggattatrgactcccgccaccacgcccagctaattttttgtatttacaggatcacacctgtaatcccagtattttgggaggccgaggcaggcggatcacctgaggcca

SEQ ID NO: 69660 - DNA, 201 bp, Homo sapiens
agaagagggaaaggtcagtgaggctagcccctggctctgcccttatgtcttgccgtcctcctgggcccggggtggcgggaatctgaggtggggtcgccagraagggtggtgttggaatccaggccccctgtaccttgcaggtgcccatggcgtccgagcggggcaaggtcaagcacaactggagcagcacgtcggaagggt

SEQ ID NO: 69661 - DNA, 201 bp, Homo sapiens
caggggctgccagcctccttttgtttcacttttgcccccttcttgggaacatttgaccaaaaataatcctcatttcatcttgtgtacagtcctttgtgtamcccgcccaggttgagaggtgaatcagcgtaattctccgaagctctgctgggcagctcagccatgttacattgtctatgcagaataagcaggcctggtgtc

SEQ ID NO: 69662 - DNA, 201 bp, Homo sapiens
tatttcacttgtcttacctttctcctggttttcccttcccttaccagctaaaatgtgagctccaggaggcagacgttcttgtgtgttattactattatttwtttttttgagacagcgtctccaaaagtttggagcgtctccacaggctggagtgcagtggcacaagctcggcttactgtgaccttgaccttccacactcaa

SEQ ID NO: 69663 - DNA, 201 bp, Homo sapiens
aatcatgaaaaagtttgtgccccctgactacaagatccataggttagaagactggaacttcagcgggcaaatgaaagaaacacttcctctgtcaagttgatgaggacagcaatgatcgtattctgtcattatacactatctattcttttttttttttttcgagacggaatctcaccctgtcgcccaggctggagtgtagta

SEQ ID NO: 69664 - DNA, 201 bp, Homo sapiens
cctttacaaagttcagaaaaatttacagcagctccttccctaaggaatttcagggctgcatctctgacttctgtgatccccgcaccctgacagattgcctrtgggaggagctgttgaaagaggatctggtctggggggcctttggctgtcaccctcattttgcacgttactacagtgagagtcaagaaagaaatcttttgc

SEQ ID NO: 69665 - DNA, 201 bp, Homo sapiens
gagcacccctcttctggaagtgactggtctgatgttgaggagatctccacagtcagattctctcaggaggaacctgtctccctgaaaccttcagccgttcyggagccttcttccttcaccaccgactatgtcatgtaccctcctcatttgtacagtagtccttggtgtgactacgccagctattggaccagcagccccaag

SEQ ID NO: 69666 - DNA, 201 bp, Homo sapiens
gcctgcctcctactccagagaaactgatttattgggctgaggtgtggtctgggcttccagatttttcagtgctccccaggttattgtaaacgtgcagcccygttggagaatcactgcagtagaaggtggattatgtgctcaagagaagaatgtatttattttagttgtcagtttaaagaattgtgtgcccttgtactttga

SEQ ID NO: 69667 - DNA, 201 bp, Homo sapiens
acagggtgagctaatgagccaatgcaaagccatcaccatggccagaagaacaagccagggtttatgttcagctgatgacagcctgggaggccatcttcacrtcggaaggctaacccactgttgtatgccttcttttctgcagcataaagatagggaggtggtgatggagcacccctcttctggaagtgactggtctgatgt

SEQ ID NO: 69668 - DNA, 201 bp, Homo sapiens
gagggtttagtttgtgccaggcaatgttctaggtgtttgggattctttactaacaaaacagatcactttccccttagagtttgcatcctagattttgaagstctgagtcttaagaagtgagaagttctgcctgtggaggagtggagaaacagtcttatttgggatcagatgggctgcctctagagaaaattactttacaaa

SEQ ID NO: 69669 - DNA, 201 bp, Homo sapiens
acttgggtacagcataaaataataccagttgattcaatttagcttcactgacaatttgtagatagagtgaaacctgttactgggagaggcaggaaatttaytttacatagtctttcaggtgtgctgaatccctggctgtcctaaagacctggaactcaggtttgagggtgtggtctctaatctgggtgggtctaattgtag

SEQ ID NO: 69670 - DNA, 201 bp, Homo sapiens
ggaaggctggggccagtctgtgaagggttcctgatgagctcaggggtagggattattctgtaggcaaatgtggagccctggaagggttctaaactaaggckgaagtggtggggtttgcattttagagctcctctggcacgctgcagagaaagggtaggagggagaagacagggagctggtgaggagctgttgaaatccttc

SEQ ID NO: 69671 - DNA, 201 bp, Homo sapiens
tgtgcgctaccgtgcccagctgatctttgtatttttagtggagatggggtttcgccttgttggccaggctggtctctaactcctgactgcaagtgatctgmccgcctcagcctcccaaagtgctgggattacaggtgtgagccaccatgcccggccaattgtattcttattttaaaaaaattattttatttttttgaaacg

SEQ ID NO: 69672 - DNA, 201 bp, Homo sapiens
gtggtgctagttttttttttttttcttttttttttggaggttaaattgttaattccctaatggaaacatgcaagagggtttcataagtactttgagcagaccaaggagtgcttcacagagaagatacatttcgctcatctactcaatcaaggctttgaacaaatatgtgttgagggtttagtttgtgccaggcaatgttct

SEQ ID NO: 69673 - DNA, 201 bp, Homo sapiens
ttaataaacctaaactaagtgcttttttttttttttgaaggatttatatgttaggatatgggtttagctgctgtgtaaaaggccaaaatcacagtggcttraacagaatataagtttggcttaagaaggatggctccatcatgtcagagatactggtaccttttgtcttgattctctatcacccctcaacacagtgtccat

SEQ ID NO: 69674 - DNA, 201 bp, Homo sapiens
cttcagcaagcacagccgaggggtactcacaaaaatggcatgttcatcctcaggtccttctagagtcctctcactgctctcctgtgtctgctctgtaaactttttttttttgtttgagacagggtcttgctctgtcacccaggctggagtgcactggcatgatcatagctcactgcatctcaacctcctgggctcaagcga

SEQ ID NO: 69675 - DNA, 201 bp, Homo sapiens
ccaaagtgctgggattacaggtgtgagccaccatgcccggccaattgtattcttattttaaaaaaattattttatttttttgaaacgatttcccaggctgragtgcagtggcgcaatcatgtctcactgtagcctcaaactcctggggtcaagcaatcttcttaaataggtgagaatatgggcatgtgccaccacaccctg

SEQ ID NO: 69676 - DNA, 201 bp, Homo sapiens
tcatagctcactgcatctcaacctcctgggctcaagcgatcctcctgcctcagcctcccaagtaggtggaactcaggcgtgtgccaacctgcctggctaatttttttttttttttttttgagacagaatcttgctctgtcacccaggctggagtgcagtggtgcaatctcggctcactgcaagctccgcctcccgggttca

SEQ ID NO: 69677 - DNA, 201 bp, Homo sapiens
tgcccaaaatgtcaggaaatgctgcttgtctggagtgcttggggcactgctggccctcccttctctcatccgtgctctcctgcgttccctggacacttgcrtgtttggaggaaggcaggagatgaggctagacaggaaggctggggccagtctgtgaagggttcctgatgagctcaggggtagggattattctgtaggcaa

SEQ ID NO: 69678 - DNA, 201 bp, Homo sapiens
gtagttatagaccctcaagagaaacccagtgaggagccccttggggaccgaaggactgtcattgacaaatgctctccacccctagagttcttggatgactstgactctcatttagaaatccaaaaggtgagtaaagcttgtaccaggcatctgactttttagttctgttgatgaaatgtgttccatctttctagtttgatc

SEQ ID NO: 69679 - DNA, 201 bp, Homo sapiens
tcctcctcctccttctccccacatttcttgggccctggtgtgggcggggccgcctccaaaggctgcctgattcggaacactcgggggttcctgtcttcagrgggatcccctctgcgtcctgccaacgcctctttggaagaaatggcttctctagaggaggaagcctgcagccttaaggtaggtggctgccacgctttgcaa

SEQ ID NO: 69680 - DNA, 201 bp, Homo sapiens
ggtcagtgaggctagcccctggctctgcccttatgtcttgccgtcctcctgggcccggggtggcgggaatctgaggtggggtcgccaggaagggtggtgtkggaatccaggccccctgtaccttgcaggtgcccatggcgtccgagcggggcaaggtcaagcacaactggagcagcacgtcggaagggtgtccccgcaagc

SEQ ID NO: 69681 - DNA, 201 bp, Homo sapiens
aaatgctctccacccctagagttcttggatgactctgactctcatttagaaatccaaaaggtgagtaaagcttgtaccaggcatctgactttttagttctsttgatgaaatgtgttccatctttctagtttgatcctaagtgttactaattaaaaatagtactttacttaaccaggcctccaggaaacaaactgatggttt

SEQ ID NO: 69682 - DNA, 201 bp, Homo sapiens
ctgcattctaatgagttcttcttccttcttaacatttttgaaatctggatgtgtttcatgaaacattataaatgtaatgttattgttccttggaaaattgyaaggtacaatacaattgcaaggaacagttgcacagtggcttgtcttccatgcacctgtcgtaggttggatgtgtgtgcttgtgttaaagaaagaaattag

SEQ ID NO: 69683 - DNA, 201 bp, Homo sapiens
tctcttggtgtgaaatggatactctgataggactcagggtttgttatctgggcattctggccagtgggaaggggagaagaggagagtgcattccttccctkttaagagcttggctcaagagttgcacatgttgtatctgctgttgacaagagcggggaaacccggctgacacctggctgcaagggagtctggaaaatcagc

SEQ ID NO: 69684 - DNA, 201 bp, Homo sapiens
ctgcggcagccggcggggggcgtcctgagttggcggtcgagggcgctgccagctcccgaggggccgctcgggccccttccggcccgggtctggttgggcckcaggagcagggcgggctgcggcgcccgggtctggccctggcctacgggctaagcgcccggccccggggccgcggatccggcagccatgtgtggatcttga

SEQ ID NO: 69685 - DNA, 201 bp, Homo sapiens
taatctttggttgtctgtttatgatcaagaatgggaggattaaaaagctgtttggaagctctgagcgtaaagactttgagctttgctttgggatgatcggsagaacataaccctcttccccttgccatgtcactgcttttaggaaagcctcgagactggtcaccttgcccagaggagtgtttttcagcctgcttaggagga

SEQ ID NO: 69686 - DNA, 201 bp, Homo sapiens
ttgaactaataaccctaaatcaccagtgagcacaaggggccttttgtgcccccatcctggggatgggcagaaatggagtttcagttctcagcagtgaggaytgctgatcttgagaggttgctgtggggtgtggtggcttagcacacagagcatcttagggtacttgaaaggacattttctttcctcttttgaacttgaaag

SEQ ID NO: 69687 - DNA, 201 bp, Homo sapiens
cctggccggctccttaaagatggttgagaggggttggctgaataacaaggactctagcacccaaatcgggtcttgtcagatggcagaaaaaggaggatggkgctgtcagggcctttgggtacctaagcagaatgagtgaagcctctgacccctggctgctgcacacaccaatgatgaggcagtcagttggcttttctgggt

SEQ ID NO: 69688 - DNA, 201 bp, Homo sapiens
cttaaagatggttgagaggggttggctgaataacaaggactctagcacccaaatcgggtcttgtcagatggcagaaaaaggaggatggggctgtcagggcytttgggtacctaagcagaatgagtgaagcctctgacccctggctgctgcacacaccaatgatgaggcagtcagttggcttttctgggtcggttggttttt

SEQ ID NO: 69689 - DNA, 201 bp, Homo sapiens
ttgcccagactggtcttgaactcctaggctcaaatgatcctcctgccttggcctcccaaagtgctggaattgcaggcatgagccaccacacccagccttgtttttttttttattgaacgctaaacccacaggtccagaaccgtgcctgctggcacagagtaagtgcttagtaagtgcttgcttaatggttgaaaagtgcac

SEQ ID NO: 69690 - DNA, 201 bp, Homo sapiens
attgccataatgtgaccacctccaattattttgcagacatgttaatgatgtgttactgtatatgataaacattttaactttcaggtgcacctatacaaaastagacttgtagttccaatatgtttcactagaaaattcagcagggaaaaaaaacaaaacagaacacaaaagccttgtcaaacttaggcaagactgtaattt

SEQ ID NO: 69691 - DNA, 201 bp, Homo sapiens
agattttgcctcaaaaaaaaattatatatatatatatatatgaattccttaaatataaaaagatacaaagaaaacaggctgagcgcggtggctcacacctrtaatcccagcactttgggaggccgaggtgggtggatcaccagaggtcaggagttcaagaccagcctggccaacatggcgaaaccccgtctactaaaaata

SEQ ID NO: 69692 - DNA, 201 bp, Homo sapiens
ccaccgcgccccgtgtgttttatagagatggggtttcgccatgttggccaggcttgtctcgacctcctgggttcaagcagtccacctgcctcggcttcccraagtgctggattacaggcatgagccactgtacctggtctgtatttacttttgagaggaatttaatagaaatgacttaggaatgcaaatgggataatggtt

SEQ ID NO: 69693 - DNA, 201 bp, Homo sapiens
tagtactttacttaaccaggcctccaggaaacaaactgatggttttcttctaacatacttttcagattttcagagttattaataaacctaaactaagtgcttttttttttttttgaaggatttatatgttaggatatgggtttagctgctgtgtaaaaggccaaaatcacagtggcttaaacagaatataagtttggctta

SEQ ID NO: 69694 - DNA, 201 bp, Homo sapiens
aggacatttcgggcatagggagcaatacatgcccaaaatgtcaggaaatgctgcttgtctggagtgcttggggcactgctggccctcccttctctcatccrtgctctcctgcgttccctggacacttgcgtgtttggaggaaggcaggagatgaggctagacaggaaggctggggccagtctgtgaagggttcctgatgag

SEQ ID NO: 69695 - DNA, 201 bp, Homo sapiens
agtggaaagaagagggaaaggtcagtgaggctagcccctggctctgcccttatgtcttgccgtcctcctgggcccggggtggcgggaatctgaggtggggycgccaggaagggtggtgttggaatccaggccccctgtaccttgcaggtgcccatggcgtccgagcggggcaaggtcaagcacaactggagcagcacgtcg

SEQ ID NO: 69696 - DNA, 201 bp, Homo sapiens
atttaattgtaaaattattagaggtatttgttgtagagctttatatattaaagagaggtattggtgcatataaaaacagtaatattattgttatgcttgtwttcttgcatttcagggtaagtaaaccctgaagaaatcttattttagtatagctacagctgcagtagcttttaagtatgtatcaacatttcattataaatt

SEQ ID NO: 69697 - DNA, 201 bp, Homo sapiens
aggaagtccgcccgcctcggcttcccaaagtgctaggattacaggcgtgagccactgcacccggccggtctttgtatttttaaatgcaacacaaaatgtgkaacttctgtggcatttagttttgatagtcttggctttgttttttgctgttacagatttcttttctgttcttcagtagaagactccaccccttagtaggat

SEQ ID NO: 69698 - DNA, 201 bp, Homo sapiens
caggatcttgctttgtctcccaggctggaacacagtggtgtgatcatagctcactgcagcctgaaactccttggcttccacctcagcctcccaaagcattrggattataggcgtgagccactgcacctggccaagtaatttcttttaggaataaaaggtacttggcattccttatttgggaagtaattacagtcttatctt

SEQ ID NO: 69699 - DNA, 201 bp, Homo sapiens
agtgatccttttttttaagcactataagtgtattttgcagtgtaaattagcagtgcttaatgtcatttttatgacataagctctttattaaaggcaatacmttaaattagaagtctaccctcattttactcttataaaatgccaattgcttgatctactgaaataataaggcatatagattaatatgctaattatttggaa

SEQ ID NO: 69700 - DNA, 201 bp, Homo sapiens
aatcccagcactttgggaggccaaggcgggcggatcacgaggtcaggagatcgagaccatcctggctaatgtggtgaaaccccatctctactaaaaaaaaatacaaaaaaattagccgggcgtggtggcaggcgcctgtagtctcagctactcaggaggctgaggcaggagaatggcgtgaagccaggaggtggagcttgc

SEQ ID NO: 69701 - DNA, 201 bp, Homo sapiens
gccgagcatggtggtggactcctgtaatcccagctactcaggaggctgaggcaggagacttgcttgaacctgggaggcagaggttgcagtgagtggagatkgcgccactgcactccagcctgggcaacagagtgagactccatctcaaataaataaataaatatctttctttactacatttattcatagttttctatctgc

SEQ ID NO: 69702 - DNA, 201 bp, Homo sapiens
cacaaaatgtggaacttctgtggcatttagttttgatagtcttggctttgttttttgctgttacagatttcttttctgttcttcagtagaagactccaccycttagtaggatgaattacagtcagccctccatatccatgggttccatatttcaaccaactgcagattgaaaatactcagaaaaaaatcgtgtctgtatag

SEQ ID NO: 69703 - DNA, 201 bp, Homo sapiens
ctggttttataattgttgtctaaagtttgctagtagtgtttcttcaaaggttattccaggtatggttaagtagtgagaaaaatcacttattaattttcaaraactttgagactaatttgtattgactcggttttttaaaataactggcaaatgctatgcttctacttttaaaatttgtggtaatacccagaatggatgtaa

SEQ ID NO: 69704 - DNA, 201 bp, Homo sapiens
gaaaaactttagaaaacattaaaaccagtccctctcatttttggaatttctgataaaaccattttataaagatgcataaatttgcctgaaattttaacttygcctgaaattttaacttcacagagaactcaagcatggtatattctgagatataactttggcttttacaggtatatgaacatgtctatgagactgtggaca

SEQ ID NO: 69705 - DNA, 201 bp, Homo sapiens
aaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagc

SEQ ID NO: 69706 - DNA, 201 bp, Homo sapiens
aagaaaacacatttttagaattactgtacttagaaaaacctctttcctaatgccttcccacaaacaaatgtgcacttaatgttgctgatttgctctttacsgtgttcaccatttggaagcctcactgtaaatgagattgtttccgttaagcctattaaagcatcattttagaggactagctactctgggaagacttgccga

SEQ ID NO: 69707 - DNA, 201 bp, Homo sapiens
tttgggttcaacatttcttaagaaaaactttagaaaacattaaaaccagtccctctcatttttggaatttctgataaaaccattttataaagatgcataamtttgcctgaaattttaacttcgcctgaaattttaacttcacagagaactcaagcatggtatattctgagatataactttggcttttacaggtatatgaac

SEQ ID NO: 69708 - DNA, 201 bp, Homo sapiens
tgcagtgacactgtggcaggctatatctgcaggtgcccagagacctggggtgggcgcgactgttctgtgcagctcactggctgccagggccacacctgccygctggctgccacctgcatccctatcttcgagtctggggtccacagttacgtctgccactgcccacctggtacccatggaccgttctgtggccagaatacc

SEQ ID NO: 69709 - DNA, 201 bp, Homo sapiens
gcctacggggggacttgaggggaccatgagaaatcctctgggaattggtttggctgataggtactgaggtccccatcataagaggcatgtaagttctgggycagtactgtgattctggccccagacattactgaaccttggctttgtctctcccaaagggccgacatgtgaggaagatgtggatgaatgcctgtcggatcc

SEQ ID NO: 69710 - DNA, 201 bp, Homo sapiens
cctgaggctgggggagccctccctgccccagagctccacaggctgtagggtgtgggggccaagtgtctcccagtcccacctggggaccctcatgtttcccrcactcacaaagctttcatttcctatcctctctatggggccctagggaggatgaggaccccattttgcagtgaaggaaaccaaggctcagagagggacggg

SEQ ID NO: 69711 - DNA, 201 bp, Homo sapiens
gcctctgctctctccccaggttgcctgtcccatccaaggagtgcagcctgaatgtcacctgcctcgatggcagcccatgtgagggtggctctcccgctgcyaactgcagctgcctggagggtcttgctggccagaggtgggtctgggggcctgggaactgtgaggaggtccaatgaatgtggagggctgttcctccagcca

SEQ ID NO: 69712 - DNA, 201 bp, Homo sapiens
taactctggagcaggcctggcgcgacctcttccgccctgctctgggtgtccatcctgcaccctgtgtgtcccctgccctgtccaggcgtgacctgcgagayggaggtggacgagtgcgcctcagcgccctgcctgcacgggggctcgtgcctggacggcgtgggctccttccgctgtgtgtgcgcgccaggctacgggggc

SEQ ID NO: 69713 - DNA, 201 bp, Homo sapiens
ttccttgttgaacttggcaacatcacctagctcatttaggtaattactggctgaatcaccccccaccatgtcctggcctagactgctgtgagccccatgarggcagggctgtctgtctcgtttctctccctgcggttgctggcatgacccgtcccccaccccccaaccaccaccaccaccatccggctctgaatgaatgaa

SEQ ID NO: 69714 - DNA, 201 bp, Homo sapiens
ttgttaccaaaagcagcccttgactgcggtgctgaggagctgaatagttcagcatttgatgaggggattcttttatgatctaattttcagactgggaaacrgaggctctgtaggagaaatgacttacccagggtctcatagctaggaactttctgagctgaaattgaacccaggtctgtttcacttcaaagctcaagttct

SEQ ID NO: 69715 - DNA, 201 bp, Homo sapiens
gggtgggggaggggcacctttgggagctccggatgggggtggggggaggaatggaggctgtgtcttctggaggctctcctcccccatcccttaccgagttsttaccaaaagcagcccttgactgcggtgctgaggagctgaatagttcagcatttgatgaggggattcttttatgatctaattttcagactgggaaacgga

SEQ ID NO: 69716 - DNA, 201 bp, Homo sapiens
gtgggtagtgatgtggagaaggggtaggaatgagaccagcggagcacacgatccctgcttttgaagttgtccacccatcctccagaggttgaggtcgggcycatctccagtttcacccagggatggagttaccagacccctggcagaagaggtggagggggcagtgggaggagcctcaccctctggggcctccttggatgg

SEQ ID NO: 69717 - DNA, 201 bp, Homo sapiens
cctggggctgggtcttcactgctcccagggcagcctgctcccagctctgattttctctgagtaggtccttgtgctgcgctctctgctctctgagggccccrgcgtcctccccttctctgcggtcttaggcctcggtgtcgtgtctcttgcagaagggcctgcccctgccgctgccattcccactgctggaggtggccgtac

SEQ ID NO: 69718 - DNA, 201 bp, Homo sapiens
ccttccacaccccccacacaagaggtatttccactgcagggagagctttgggggctgtcaccgtctattgacaagagcacaaagctcctagctgggtcagsggcttcctcagagtgcccagggcagtggcagtgaggacagatggtctctgccaatccaaccaggactcagggccatgttggtgttctgggatttaggttg

SEQ ID NO: 69719 - DNA, 201 bp, Homo sapiens
aatgtatctgcaatgccagattctccggccagttctgtgaagtggcggtgagtgttgtcaggggtgaggggccgtggacgtggcctgctgggcccttggcragatgctgctggggagagagcgcagcaccatggggctgttcctgggccactctgtcatggggtggggcagtgagaggagcctcaggtcccttccacaccc

SEQ ID NO: 69720 - DNA, 201 bp, Homo sapiens
gggcctgggaactgtgaggaggtccaatgaatgtggagggctgttcctccagccagggtggggcgggggtcctcgcccaccttctcacccctccctggtawcacagtcaccattgtcacttgagtttccttccatgactcgcaagaccatcctctgtgatacagactgctgctgggcagtggttgcctggtggcagttctg

SEQ ID NO: 69721 - DNA, 201 bp, Homo sapiens
tggggcacctgccttcacacaggctcccgtcaccctaatgggatgagagtccttctcagtgacggctgctcaggtggtcacctggcagggcccagctgggyaggagcagcgcatggggacagtggatggataagctctgatgcttgctgaagtggggatgggcagcagagcagctgggagcacaagaggcagccatggggg

SEQ ID NO: 69722 - DNA, 201 bp, Homo sapiens
gacggccgcttcgagtgccgctgcccgcctggcttcgggggcccgcgctgcaggtgggatggctgggcaggggggtgggctgcgaatgccccctggggctrtggtggggcagagaagtctgccaggtctgtggatgagtcgcttcccttccctggtcctcatgtccttatctgtgacatgaggaggacagtttaatttgat

SEQ ID NO: 69723 - DNA, 201 bp, Homo sapiens
cccctcaaggaatgtccaggcgttgtgtttaggacctgcttttgttcagagtccttacactttgttgtcctgagtcctctgagactctggaaagcgagtgacaaccctgtgtcccttccctcccatcagggacctcaatcccatgcccaatagaggaaggccctgagttccatacatgagaacacaagctcaggtggccca

SEQ ID NO: 69724 - DNA, 201 bp, Homo sapiens
cctttctgctccaagagctgccaggtcccaacctcacagtgtctttccttctccgcactcgggagtccgctggcctgttgctccagtttgccaatgactcygcagctggcctaacagtattcctgagtgagggtcggatccgggctgaggcgccgggcagtcctgctgtagtgctccctgggcgctgggatgatgggctcc

SEQ ID NO: 69725 - DNA, 201 bp, Homo sapiens
tggtttggctgataggtactgaggtccccatcataagaggcatgtaagttctgggtcagtactgtgattctggccccagacattactgaaccttggctttrtctctcccaaagggccgacatgtgaggaagatgtggatgaatgcctgtcggatccctgcctgcacggcggaacctgcagtgacactgtggcaggctatat

SEQ ID NO: 69726 - DNA, 201 bp, Homo sapiens
ggcagtggctctcccgggagcccagcgtgtggaaggggatctggctgtggcctgacccctccctctcccctcaaggaatgtccaggcgttgtgtttaggasctgcttttgttcagagtccttacactttgttgtcctgagtcctctgagactctggaaagcgagtgacaaccctgtgtcccttccctcccatcagggacct

SEQ ID NO: 69727 - DNA, 201 bp, Homo sapiens
tgtccttttgctgatgaggaaactgaggctcaggaggtgaagtgacctgcccagggtcccactacaggagggtggcagggcagatttacatctgtctcttyagcccagctgctcctaccctctggcggtccccgtgtctccccgagctagtcctggtgtgagagagacaccctgaccgagatagagagctgcctgagcctt

SEQ ID NO: 69728 - DNA, 201 bp, Homo sapiens
ttggggtctggagtgggttccaggaatctgtattcttaatgtgggcccgtgattccgggaagcttggagtgaggccctgggtttggattccagcctccctygggctgtggactgtgaggctgcttcgagtctccctttcctgagctgtaaaacaggcatcataatcctatccacctcggaggtaaatgccaagatcaactg

SEQ ID NO: 69729 - DNA, 201 bp, Homo sapiens
gctatcgtggcctcctaggctcactcctggaagacagagacaacctgaggtcagcggttcccacacctaaaagtgaaaggaatcccccaggagcaggttgsgatgcagattctcaggctcagggcccagtggttctaaatttggggtctggagtgggttccaggaatctgtattcttaatgtgggcccgtgattccgggaa

SEQ ID NO: 69730 - DNA, 201 bp, Homo sapiens
gccctgcctctcccacagcctgacccctgtttcaatggtgggacttgcctcgtcacctggaatgacttccactgtacctgccctgccaatttcacggggcstacgtgtgcccagcagctgtggtgtcccggccagccctgtctcccacctgccacgtgtgaggaggtccctgatggctttgtgtgtgagtgtgtgtcctgg

SEQ ID NO: 69731 - DNA, 201 bp, Homo sapiens
tgcctctcccacagcctgacccctgtttcaatggtgggacttgcctcgtcacctggaatgacttccactgtacctgccctgccaatttcacggggcctacrtgtgcccagcagctgtggtgtcccggccagccctgtctcccacctgccacgtgtgaggaggtccctgatggctttgtgtgtgagtgtgtgtcctgggcag

SEQ ID NO: 69732 - DNA, 201 bp, Homo sapiens
gcctgcacacccctggggctgggtcttcactgctcccagggcagcctgctcccagctctgattttctctgagtaggtccttgtgctgcgctctctgctctytgagggccccggcgtcctccccttctctgcggtcttaggcctcggtgtcgtgtctcttgcagaagggcctgcccctgccgctgccattcccactgctgga

SEQ ID NO: 69733 - DNA, 201 bp, Homo sapiens
ccagtggctggcagggggtgggtagtgatgtggagaaggggtaggaatgagaccagcggagcacacgatccctgcttttgaagttgtccacccatcctccmgaggttgaggtcgggcccatctccagtttcacccagggatggagttaccagacccctggcagaagaggtggagggggcagtgggaggagcctcaccctct

SEQ ID NO: 69734 - DNA, 201 bp, Homo sapiens
cattgtggtgacaaggctctcaggaaggcaggaggagaggaagggggatgaggatctctgggcgtggcttccaagccggttggtgaccctctgttagagcyccggtgctggaagcatcatggtggccaggggcaggtgtccgtgagccatctcaatacctgctctgtaccatgcgaccttggccaggccggccactcaggt

SEQ ID NO: 69735 - DNA, 201 bp, Homo sapiens
tgggaaacggaggctctgtaggagaaatgacttacccagggtctcatagctaggaactttctgagctgaaattgaacccaggtctgtttcacttcaaagcycaagttctcacctgggcattgtggtgacaaggctctcaggaaggcaggaggagaggaagggggatgaggatctctgggcgtggcttccaagccggttggt

SEQ ID NO: 69736 - DNA, 201 bp, Homo sapiens
gcactcgggagtccgctggcctgttgctccagtttgccaatgactccgcagctggcctaacagtattcctgagtgagggtcggatccgggctgaggcgccrggcagtcctgctgtagtgctccctgggcgctgggatgatgggctccgtcacctggtgatgctcagcttcgggcctgaccagctgcaggacctggggcagc

SEQ ID NO: 69737 - DNA, 201 bp, Homo sapiens
ccatgggttatgagtgctgcaccctcctgagcagtgctggccacacccagtcccagggctgtgccctgcatcaccttggtgaatcctttcaacacctccaygagatgggcactttttgcaccccagatacaaaccaggactgcccgatgccccaaacctgtgccctttcctgggggagctggaaggatgcgggtcaggcca

SEQ ID NO: 69738 - DNA, 201 bp, Homo sapiens
agggacaggtgctacagacacatgtggatctaccagcacatgcacctacctacacacatggcatgtgcctgcacaccaatgtgcacaccccaacacgcacrtgtggacatgtgtgcattcacactcagtgtgcactcacaggggacctggaggcacagagtggatggaggctgtggggggtctggacactggtgtgtacac

SEQ ID NO: 69739 - DNA, 201 bp, Homo sapiens
cagtggatggataagctctgatgcttgctgaagtggggatgggcagcagagcagctgggagcacaagaggcagccatgggggaagccgctttctcagcccmcctccctctccaggtgtcaggtccccactctcccctgtgaagccaacccctgcttgaatgggggcacctgccgggcagctggaggggtgtctgaatgtat

SEQ ID NO: 69740 - DNA, 201 bp, Homo sapiens
aattattctgcccaaaagagaatttcaccctttcctgatgactgagtgagtgtctgcaagcctccatggttattcagccctacccttgtagggtagagccytggggcccagggatattagatgaacaatttcttcccctatgctagaagttcccacaccttatgagatcttaggtcgcttcttagaaatattctgtctctt

SEQ ID NO: 69741 - DNA, 201 bp, Homo sapiens
caataaacgcccatctctgtccttctagccagaactcctttgttgtataggcctccccgagcagtggctgtgacaggtggtttcctggcacttgcctgcayacccctggggctgggtcttcactgctcccagggcagcctgctcccagctctgattttctctgagtaggtccttgtgctgcgctctctgctctctgagggc

SEQ ID NO: 69742 - DNA, 201 bp, Homo sapiens
ttcagagccccccagtgcctgtgcctcagacccgtgcgctccagggaccgagtgccaggctaccgagagtggtggctatacctgtgggcccatggagcccyggggctgtgccacccagccatgccaccacggcgctctgtgtgtgccccagggtccagatcccaacggcttccgctgctactgcgtgccgggtttccaggg

SEQ ID NO: 69743 - DNA, 201 bp, Homo sapiens
cggggccctttaccatgggttatgagtgctgcaccctcctgagcagtgctggccacacccagtcccagggctgtgccctgcatcaccttggtgaatccttycaacacctccatgagatgggcactttttgcaccccagatacaaaccaggactgcccgatgccccaaacctgtgccctttcctgggggagctggaaggatg

SEQ ID NO: 69744 - DNA, 201 bp, Homo sapiens
cgcttcttagaaatattctgtctcttgatttgttgggacaggaagcttccccagtaaatgcttctttttttgtttgtggtttttcgtttttttttgttttyttttttttttttttttttttaagaaagggtctcaccctgttgccctggctgcagtgcagtggcaaaatcatagcccactgtagcctcgacaccctgggct

SEQ ID NO: 69745 - DNA, 201 bp, Homo sapiens
aggtcgcttcttagaaatattctgtctcttgatttgttgggacaggaagcttccccagtaaatgcttctttttttgtttgtggtttttcgtttttttttgkttttttttttttttttttttttttaagaaagggtctcaccctgttgccctggctgcagtgcagtggcaaaatcatagcccactgtagcctcgacaccctg

SEQ ID NO: 69746 - DNA, 201 bp, Homo sapiens
gcctggctctgagggtgcaggtgggacccacagctgggcctcttacaggagccgactgcggtgtggaggtggacgagtgtgcctcacggccatgcctcaayggaggccactgccaggacctgcccaatggcttccagtgtcactgcccagatggctacgcaggtgtctggggtggggtgggccctgggaccatcagaattg

SEQ ID NO: 69747 - DNA, 201 bp, Homo sapiens
agcagtgccggcctctgccttgtgtccacggagggtcctgtgtggatctgtggactcatttccgttgcgactgtgcccggccccatagaggtcccacgtgygctgatggtgaggaataagccaggtgggaaggcagcacctgagatctgcctccctcagcctgcaggcctcacacctggcaccttctctccctgcagagat

SEQ ID NO: 69748 - DNA, 201 bp, Homo sapiens
acttcaccggctgcttgggccgcgtggcgctgggcggcctgcccctgcccttggcgcggccccggcccggcgcggcccctggcgcccgagagcacttcgcstcttggcctgggacgccggccccgatcctcggctgccgcggcgcgcccgtgtgtgcgccctcgccctgtctgcacgacggtgcctgccgtgacctcttcg

SEQ ID NO: 69749 - DNA, 201 bp, Homo sapiens
aggccatggcctgcccggcgctgtgctgcccataccggggccgcgcgtggccgatggtgcctggcaccgcgtgcgtctggccatggagcgcccggcggccrccacctcgcgctggctgctgtggctggatggtgccgccaccccggtggcgctgcgcggcctggccagtgacctgggcttcctgcagggcccgggtgctgt

SEQ ID NO: 69750 - DNA, 201 bp, Homo sapiens
ctccgcactcgggagtccgctggcctgttgctccagtttgccaatgactccgcagctggcctaacagtattcctgagtgagggtcggatccgggctgaggygccgggcagtcctgctgtagtgctccctgggcgctgggatgatgggctccgtcacctggtgatgctcagcttcgggcctgaccagctgcaggacctgggg

SEQ ID NO: 69751 - DNA, 201 bp, Homo sapiens
gagaccaacctggccaacatggtgaaacgccttttctacaaaaaaatacaaaaattagccgggtgaggtggcatgcacctgtaatcccagctactctgcartctgaggcacaagaatcacttgaacccagtgggcagagattgcagtgggctaagattgcagcactgcactccagcctgggcgacagagtgagactctgtc

SEQ ID NO: 69752 - DNA, 201 bp, Homo sapiens
ggtgaggtggcatgcacctgtaatcccagctactctgcaatctgaggcacaagaatcacttgaacccagtgggcagagattgcagtgggctaagattgcascactgcactccagcctgggcgacagagtgagactctgtctcaaaaaaataaaaaacaaaaacaaacccaaaacaactaactaaaatgtaggtgggaccaa

SEQ ID NO: 69753 - DNA, 201 bp, Homo sapiens
gagagtggtggctatacctgtgggcccatggagccccggggctgtgccacccagccatgccaccacggcgctctgtgtgtgccccagggtccagatcccamcggcttccgctgctactgcgtgccgggtttccagggcccacgctgcgagctggacatcgatgagtgtgcatcccggccgtgccaccatggggccacctgc

SEQ ID NO: 69754 - DNA, 201 bp, Homo sapiens
gcgggaggtgctggagtgcgcatcggcgccctgcgagcacaacgcgtcctgcctcgagggcctcgggagcttccgctgcctctgttggccaggtgtgtgcrtgcaggtgcgcggcctggcggggggaggggtaggtgtgcgcctgtgcggcctggggcggtggggcaggtgtgtggctgcacgcgagtgcccgctgggtcc

SEQ ID NO: 69755 - DNA, 201 bp, Homo sapiens
cctcccccgccccccaggatcctttccccggtgctgcctccccagcgtggtcccagctgctctgagatagggggcaaagcttcagattggatgggcggggrggcggggggggttccttgcactgcacaggtgagggacagtgctctgtgggaattaagtgagggacctgttggcacaggcgctggcagccggggcccttta

SEQ ID NO: 69756 - DNA, 201 bp, Homo sapiens
gcgccctgcgagcacaacgcgtcctgcctcgagggcctcgggagcttccgctgcctctgttggccaggtgtgtgcgtgcaggtgcgcggcctggcgggggsaggggtaggtgtgcgcctgtgcggcctggggcggtggggcaggtgtgtggctgcacgcgagtgcccgctgggtcctcgggaccagagtgtgtgtgtgatt

SEQ ID NO: 69757 - DNA, 201 bp, Homo sapiens
ctcgaaggtgcgacgcctgggaagcccttggggagggcctgacagctgcaaagggctcagtaattaatgctagtaatagtagtaagactaggccgggcgcrgtggctcaagcctgtaatcccagcactttgggaggctgaggcgggcggatcacgaggtcaggagttcaagaccagcctggccaacattgtgaaaccccat

SEQ ID NO: 69758 - DNA, 201 bp, Homo sapiens
tgttgaggggggttgtaagtttcggggttgggggatcgggggctgggcatgatttgggggagctgatgcgggtgagggatggggtgcgtgttttgggaggktgctgtgttgcatcctgtaaagggctgggggacttctgggtttctaggggctgagtttggggagttgcaggtggcataagcctcaccccagagcttgttc

SEQ ID NO: 69759 - DNA, 201 bp, Homo sapiens
tgcaaagggctcagtaattaatgctagtaatagtagtaagactaggccgggcgcggtggctcaagcctgtaatcccagcactttgggaggctgaggcgggyggatcacgaggtcaggagttcaagaccagcctggccaacattgtgaaaccccatctctactaaaaatacaaaaattagccaagcatggtggcatgtacct

SEQ ID NO: 69760 - DNA, 201 bp, Homo sapiens
taggtcgcttcttagaaatattctgtctcttgatttgttgggacaggaagcttccccagtaaatgcttctttttttgtttgtggtttttcgtttttttttktttttttttttttttttttttttttaagaaagggtctcaccctgttgccctggctgcagtgcagtggcaaaatcatagcccactgtagcctcgacaccct

SEQ ID NO: 69761 - DNA, 201 bp, Homo sapiens
attgtgaaaccccatctctactaaaaatacaaaaattagccaagcatggtggcatgtacctgtagtcctagctactcaggaagctgaggcaggagaatcgyttgaacctgggaggtggaggtgagcagagatcatgccgctgcactccagcctgggcaacagagtgagattctatctcaaaaaaaaaaaaaaaaaattagt

SEQ ID NO: 69762 - DNA, 201 bp, Homo sapiens
gcttcttagaaatattctgtctcttgatttgttgggacaggaagcttccccagtaaatgcttctttttttgtttgtggtttttcgtttttttttgtttttktttttttttttttttttttaagaaagggtctcaccctgttgccctggctgcagtgcagtggcaaaatcatagcccactgtagcctcgacaccctgggctc

SEQ ID NO: 69763 - DNA, 201 bp, Homo sapiens
tctgtctcttgatttgttgggacaggaagcttccccagtaaatgcttctttttttgtttgtggtttttcgtttttttttgtttttttttttttttttttttttttaagaaagggtctcaccctgttgccctggctgcagtgcagtggcaaaatcatagcccactgtagcctcgacaccctgggctcaagccatcctcccac

SEQ ID NO: 69764 - DNA, 201 bp, Homo sapiens
agactagtaatagcagtaataggccactgctgctgaaggctgccgtggtcattcctgcggcccttagtgtgtccctccctcgccattcgtggcttattccragctgcggtcccttgctggccctcgctagcctggtcatagtgaagaggtgctgcccggcaaccccgtgagacctgatgtccgcgtgtgtgtgcccccagg

SEQ ID NO: 69765 - DNA, 201 bp, Homo sapiens
gataactcaagccagcccagcgagctcggcggcaggcagtcctggaacctcactgcgggctgcgtctccgaggacatgtgcagtgtaagtgtctggtggcrgtggtggtggtggggtggggagtccttttcccaggatctgtcctgtgtcaccggggcttagtgtgtccttttgctgatgaggaaactgaggctcaggagg

SEQ ID NO: 69766 - DNA, 201 bp, Homo sapiens
gtgaacctccccgccacaccccttcctggggcggggtggggggagtgggtgctggcgaggagaggcttggaagggaagtctggggagcagccttgatctcyacaggcttctggcagcctgggtcataaaccacaaatcccctccgcttacggggaatgtttcctttcaagttgaacttttacagcctctggcttccctacc

SEQ ID NO: 69767 - DNA, 201 bp, Homo sapiens
ctgtctcttgatttgttgggacaggaagcttccccagtaaatgcttctttttttgtttgtggtttttcgtttttttttgtttttttttttttttttttttttttaagaaagggtctcaccctgttgccctggctgcagtgcagtggcaaaatcatagcccactgtagcctcgacaccctgggctcaagccatcctcccacc

SEQ ID NO: 69768 - DNA, 201 bp, Homo sapiens
ttaaatgtcagggtgagtgattggacttcaggcggcagaggaacccagcctggcgatgctttagaaatggacctctggctactggtggagatggatgggaragggcttctgaaggctggcgaactgggggatgcgggatggtagcccagacagctggtaaggcaggagatggggggtaggagaaaggggcattggagaatg

SEQ ID NO: 69769 - DNA, 201 bp, Homo sapiens
ggagggtgctgtgttgcatcctgtaaagggctgggggacttctgggtttctaggggctgagtttggggagttgcaggtggcataagcctcaccccagagcytgttctgtgtcgcatgctgggttgtggggcacaggttgtgggtgtgttagagttgggaggtggatgagctgtctggggtgagccgtgagttgtgtccgag

SEQ ID NO: 69770 - DNA, 201 bp, Homo sapiens
tgtctcttgatttgttgggacaggaagcttccccagtaaatgcttctttttttgtttgtggtttttcgtttttttttgtttttttttttttttttttttttttaagaaagggtctcaccctgttgccctggctgcagtgcagtggcaaaatcatagcccactgtagcctcgacaccctgggctcaagccatcctcccacct

SEQ ID NO: 69771 - DNA, 201 bp, Homo sapiens
cgccatgctgcgggtttcctgtgccactgccctcctggctttgagggtgagcccctgctggggaagcggtcagcccatgtccagatgcccagggagggatsttgtgcccacccccccaccccccccacccccccaccccacaccccacacccgagtctgccctctctcttggactcagtctctctagctatagaatggacc

SEQ ID NO: 69772 - DNA, 201 bp, Homo sapiens
gtctcttgatttgttgggacaggaagcttccccagtaaatgcttctttttttgtttgtggtttttcgtttttttttgtttttttttttttttttttttttttaagaaagggtctcaccctgttgccctggctgcagtgcagtggcaaaatcatagcccactgtagcctcgacaccctgggctcaagccatcctcccacctc

SEQ ID NO: 69773 - DNA, 201 bp, Homo sapiens
tctcttgatttgttgggacaggaagcttccccagtaaatgcttctttttttgtttgtggtttttcgtttttttttgtttttttttttttttttttttttttaagaaagggtctcaccctgttgccctggctgcagtgcagtggcaaaatcatagcccactgtagcctcgacaccctgggctcaagccatcctcccacctca

SEQ ID NO: 69774 - DNA, 201 bp, Homo sapiens
cttgatttgttgggacaggaagcttccccagtaaatgcttctttttttgtttgtggtttttcgtttttttttgtttttttttttttttttttttttttaaraaagggtctcaccctgttgccctggctgcagtgcagtggcaaaatcatagcccactgtagcctcgacaccctgggctcaagccatcctcccacctcagcc

SEQ ID NO: 69775 - DNA, 201 bp, Homo sapiens
cgttctcacagcagccgagcagagcgcagagcgggctgccatggcgctggccaggcctgggaccccggacccccaggccctggcctctgtcctgctactgytgctctgggcccctgccctttccctcctggctggtgagttggggcccatgtctggaggggcctgggagagggtctgtcccccaagacagataccccaagc

SEQ ID NO: 69776 - DNA, 201 bp, Homo sapiens
ccccgccccccaggatcctttccccggtgctgcctccccagcgtggtcccagctgctctgagatagggggcaaagcttcagattggatgggcgggggggcggggggggttccttgcactgcacaggtgagggacagtgctctgtgggaattaagtgagggacctgttggcacaggcgctggcagccggggccctttaccat

SEQ ID NO: 69777 - DNA, 201 bp, Homo sapiens
ttctgcccaaaagagaatttcaccctttcctgatgactgagtgagtgtctgcaagcctccatggttattcagccctacccttgtagggtagagccttgggrcccagggatattagatgaacaatttcttcccctatgctagaagttcccacaccttatgagatcttaggtcgcttcttagaaatattctgtctcttgattt

SEQ ID NO: 69778 - DNA, 201 bp, Homo sapiens
ttctgtgaaacccatgcaccctgcttagctcctgccgggtgttcaataaacgcccatctctgtccttctagccagaactcctttgttgtataggcctcccygagcagtggctgtgacaggtggtttcctggcacttgcctgcacacccctggggctgggtcttcactgctcccagggcagcctgctcccagctctgatttt

SEQ ID NO: 69779 - DNA, 201 bp, Homo sapiens
cttactgggacctggcttgcagacccctggccctctgtccatactgtgcatgcagagacccacgttgcttttggggtctggggtgggcctgagagggtggrgaggagattgtccttgtaacctctgcccaccctgcccagccagtttcttctttctacagggacggtgccttcagagccccccagtgcctgtgcctcagac

SEQ ID NO: 69780 - DNA, 201 bp, Homo sapiens
cactctggagctacagcaccactgtgcttgtcctgagactgccggacctggccctaaacgatggccattggcaccaggtggaggttgtgctccatctagcraccctggagctacggctctggcatgagggctgccctgcccggctctgtgtggcctctggtcctgtggccctggcttccacggcttcggcaactccgctgc

SEQ ID NO: 69781 - DNA, 201 bp, Homo sapiens
ctccctccctttaggccatgctgggcatgggggaggccagtgcctggcattcctgagcaggctccgaaggaggcagctgggccaggcagggagctctgccycctccccacttccccagcctcagtgcccgcccaccactctcaacctgtctggagggcatggcaatggagccgggggctctgtggaccttcctgggccacc

SEQ ID NO: 69782 - DNA, 201 bp, Homo sapiens
aggcacagagtggatggaggctgtggggggtctggacactggtgtgtacactcaacccatcaggcctgctgggttgcccaggggcagcctttcctctgccrtttctgtgctgggagcgccatccctggggatccctaaaagttggtggggtacactgcaggcatgaccatttctgcatgctggtaccctagactgcctgcc

SEQ ID NO: 69783 - DNA, 201 bp, Homo sapiens
attagtgtacatgccagtgcaggtcacattcgtccatgtgtctcctagttccaagttctgttttgcatctgtaaagatctgccagtacctgggggtgtctvcagtctgagtgcatgtgtgggcagtgggttgttcgggcagtgggttgtgtgggcagtgggttgtgcgggcagtgggttgtgcgggcagtgggttgtgcat

SEQ ID NO: 69784 - DNA, 201 bp, Homo sapiens
tgggtgtccatcctgcaccctgtgtgtcccctgccctgtccaggcgtgacctgcgagatggaggtggacgagtgcgcctcagcgccctgcctgcacggggsctcgtgcctggacggcgtgggctccttccgctgtgtgtgcgcgccaggctacgggggcacccgttgccagctggacctcgacgagtgccagagccagccg

SEQ ID NO: 69785 - DNA, 201 bp, Homo sapiens
gtacatgccagtgcaggtcacattcgtccatgtgtctcctagttccaagttctgttttgcatctgtaaagatctgccagtacctgggggtgtctgcagtcdgagtgcatgtgtgggcagtgggttgttcgggcagtgggttgtgtgggcagtgggttgtgcgggcagtgggttgtgcgggcagtgggttgtgcatccggat

SEQ ID NO: 69786 - DNA, 201 bp, Homo sapiens
tacatgccagtgcaggtcacattcgtccatgtgtctcctagttccaagttctgttttgcatctgtaaagatctgccagtacctgggggtgtctgcagtctgagtgcatgtgtgggcagtgggttgttcgggcagtgggttgtgtgggcagtgggttgtgcgggcagtgggttgtgcgggcagtgggttgtgcatccggatg

SEQ ID NO: 69787 - DNA, 201 bp, Homo sapiens
atcttaggtcgcttcttagaaatattctgtctcttgatttgttgggacaggaagcttccccagtaaatgcttctttttttgtttgtggtttttcgtttttktttgtttttttttttttttttttttttttaagaaagggtctcaccctgttgccctggctgcagtgcagtggcaaaatcatagcccactgtagcctcgaca

SEQ ID NO: 69788 - DNA, 201 bp, Homo sapiens
atgccagtgcaggtcacattcgtccatgtgtctcctagttccaagttctgttttgcatctgtaaagatctgccagtacctgggggtgtctgcagtctgagtgcatgtgtgggcagtgggttgttcgggcagtgggttgtgtgggcagtgggttgtgcgggcagtgggttgtgcgggcagtgggttgtgcatccggatgtgt

SEQ ID NO: 69789 - DNA, 201 bp, Homo sapiens
atgggggtggggggaggaatggaggctgtgtcttctggaggctctcctcccccatcccttaccgagttgttaccaaaagcagcccttgactgcggtgctgrggagctgaatagttcagcatttgatgaggggattcttttatgatctaattttcagactgggaaacggaggctctgtaggagaaatgacttacccagggtc

SEQ ID NO: 69790 - DNA, 201 bp, Homo sapiens
tgccagtgcaggtcacattcgtccatgtgtctcctagttccaagttctgttttgcatctgtaaagatctgccagtacctgggggtgtctgcagtctgagtscatgtgtgggcagtgggttgttcgggcagtgggttgtgtgggcagtgggttgtgcgggcagtgggttgtgcgggcagtgggttgtgcatccggatgtgta

SEQ ID NO: 69791 - DNA, 201 bp, Homo sapiens
ggaagctgaggcaggagaatcgcttgaacctgggaggtggaggtgagcagagatcatgccgctgcactccagcctgggcaacagagtgagattctatctcaaaaaaaaaaaaaaaaaattagtagtaagactagtaatagcagtaataggccactgctgctgaaggctgccgtggtcattcctgcggcccttagtgtgtcc

SEQ ID NO: 69792 - DNA, 201 bp, Homo sapiens
gaaaggaaaaagcaaagttggggacatgttggaaaaagcagcagagttactgatgagctgtttccgggtctgtgccagcgacacgtgagtaaggacttgargaccgaccaccagacgctgttggtggtgttttcattgcagcgttcaccctttctggcctgtgtttattgttgacacatatttcatttctacacatgctat

SEQ ID NO: 69793 - DNA, 201 bp, Homo sapiens
gcctttgagcattgtcaccgttctagtcagaagaacaaaaggatgattctgatctatttgcttccagtaaaaatgctattggtgagtgattattactccaygtttatagatcctggtgctttcacaaagttgacagctgataggtttttttaaaacctagcagacagtctgtagttgatcacagcctgagctgtgtatgag

SEQ ID NO: 69794 - DNA, 201 bp, Homo sapiens
atattagcttactgagccatgcagcacctcccaagtgctgatataccactgttaaaaacccaacccccaaacccctaccttccttaacatctccaggggcstcatcagaaaagccttggagtaaggaaaagctgctaagctcacagtagttcataaaagttttccagaattctggtttttcttgaaagcacaaatgttgtc

SEQ ID NO: 69795 - DNA, 201 bp, Homo sapiens
gtccgacctgggcgacagagcgagactccgtctcaaaaaaaaaaaaaaaaaaaaagaaattattgtttacccactgcagagagtagtgaccatctgttacwttttgattgttctgtcttctttcaaagtaggggaaaatgaattttcccctgtgtggcattcagtgtattgttgtaggttctattcgaacagaatatttta

SEQ ID NO: 69796 - DNA, 201 bp, Homo sapiens
gacagcagagatggagcatcttgtgcagagttggtgtcttttaaacatcctcatgttgcaaacccacgacttcaagtaggtgaaagagctgtgcacacagrtgtctgcagacaattacagggtaaccactttcctaagagaagcgtagagtttgagtaagaagaaaactaatattgtcactcttatttgaaaattttaaag

SEQ ID NO: 69797 - DNA, 201 bp, Homo sapiens
gtaagaagaaaactaatattgtcactcttatttgaaaattttaaagtttctttatgatttgtgtaatttcaatccatttgtggagcactgactatgtacgyacactgtggtgatgtggacctcctgcccttgtgtttgattcctagacagctctctgaggtttagagaagttagatggtggagaggcggtggagcttagat

SEQ ID NO: 69798 - DNA, 201 bp, Homo sapiens
catctgtaactcattagacctcacttactaaacctatgacagttacttaacaagtatttcttgactgactggtcaagaatactaatatactgaaatgtatrtgaaagtgcctagaatattttctgacttgcagaaggcgagaccaaattatattcatgggcttctttttcccctgaaatattgataaatatttgttgaagt

SEQ ID NO: 69799 - DNA, 201 bp, Homo sapiens
gcacacagtcccaagtacatgaagcaacataactttaggcaatgcaagataaataatagccctttcataaggacgctctggctttttattctataggcttktatagaccatttcctttcacagtttttactctgtgggcttgtatggactgaccatttcctttcagtttttagtagatctagggcttttaaagaagggctt

SEQ ID NO: 69800 - DNA, 201 bp, Homo sapiens
tgacttgatatgaataagttgatatgaatatgacttgagctttgggacttacctcaagatattaatttgtttaggcagtttattttgtgatttataaatamaatttttatttcctatgtaacttaaaaaaaattatttccccatagccgtgctggtatagaggactctaagaagtggggcatgctgtttctggtgaaccag

SEQ ID NO: 69801 - DNA, 201 bp, Homo sapiens
acactgggccagttgctcatttctgcagttagaaaggaatgacagtgttttggaacagaagctcgtttcagctctttcacttgggtacttaaatttagcayggatctgaagactcgtgcagtacttagtaaggaagaacactggttaggaagaaggatcttactctgctgagaagaagaatgctttgttgcctttagtaag

SEQ ID NO: 69802 - DNA, 201 bp, Homo sapiens
gtaaacagccatgagacacccgtgtgcaacagaagtgctgtatgcttctcatttcatcacaaagaatataaaaaacgtgtgctcaaggaccaagatttaaraaaattcatatttactgcattatcaaggacattttatttatttatttagagatggtcttgctctgtcacccaagctgaagtgcaatggtgcagtcatagc

SEQ ID NO: 69803 - DNA, 201 bp, Homo sapiens
gacgctgttggtggtgttttcattgcagcgttcaccctttctggcctgtgtttattgttgacacatatttcatttctacacatgctataatcccacaaccrttgttatttttgctttaaaaagttgattgttttgtaaaggaaataagagctgagggaaaaaagagtcttcatttgcccacatttgaccatgcctggagct

SEQ ID NO: 69804 - DNA, 201 bp, Homo sapiens
tttgtgtctgccttggtgggactcatcctctttgtgtgttttactggtttgttttgtcgtactgatgagaagtatttttccatttttcttttctttttttstttttgttttttgagacggagtcacgctgtgtcacccaggctgaagtgcattggcccgggtttgagtgattctcctgcctcagcctcctgagtggctggg

SEQ ID NO: 69805 - DNA, 201 bp, Homo sapiens
aatgtttgcagctcatttaaggtaatctgttggggaggaagaaaaacacacacatctggaaattgctgaattaactggggattttatcttgcattatcttrtgcttgaagcagtgaataactgactttgaaaaagtgggaaaatgcatttgtaacttcagtttggtaaagcctgtggaaattgtaaacatcagttatataa

SEQ ID NO: 69806 - DNA, 201 bp, Homo sapiens
gtggggcatgctgtttctggtgaaccagctgtttaaaatctacttcaaggtgtgcttctgtttgaatcctttctgtctttacaattttcgattgtcctggrcttcccacatatcatatatatatcagctagcctccctggcgttgcttgtgaaatgatcataaccgtattcctagtcctaatagcaaacatttgttgaatg

SEQ ID NO: 69807 - DNA, 201 bp, Homo sapiens
tagagggttgattgtatttatttttactcattgtcttcccgctgaactgaactgtgccgctcttggggaagaatgctaatgccaaattaattagatcaccyagcatctttgacatgactcagatccaaaaatgtaaacgcattcctccctttctgccccgcagggacacgtcaaaggctacatatcgcatcagcatcagaa

SEQ ID NO: 69808 - DNA, 201 bp, Homo sapiens
cacatccagctaatttttgtaattttttttgtagagacgggctttcaccatgttggccaggctggtcttgaacttctagcctcaagtgatctgcccacctygccctcccaaagtgctgggattacaggcatgagccactgtgctcacggcctgaaccttttatttagagtggtaaatataaagtgttactgtgaactgtaa

SEQ ID NO: 69809 - DNA, 201 bp, Homo sapiens
tacagggtaaccactttcctaagagaagcgtagagtttgagtaagaagaaaactaatattgtcactcttatttgaaaattttaaagtttctttatgatttrtgtaatttcaatccatttgtggagcactgactatgtacgcacactgtggtgatgtggacctcctgcccttgtgtttgattcctagacagctctctgaggt

SEQ ID NO: 69810 - DNA, 201 bp, Homo sapiens
tggggcaccaccgtgttccttgtagtacaaagcacctgtgatttcctagctctgtgcagtgtgcgataggttccagatttggcgatgaactaacactgacrttacccagctgggaatctagtttgaatgtcattgtcagcccctgctagagtggaagggtcatactatgttatcaacatgtgttactcataaacctgctgg

SEQ ID NO: 69811 - DNA, 201 bp, Homo sapiens
cagatttatataaacatttgctcagatttccacactgttcatatagagggagaggttccattttgtggttaaccatttatggtatgtgttatttttatgamgtgagtggaacaacaacaaatgagcttattctgcatctcttctacctttaagatgtggcctgctcccccaccaaaaagaattcagcttcatatagatttg

SEQ ID NO: 69812 - DNA, 201 bp, Homo sapiens
ttactgtgggacttcctcttatcctcacctgtttgtgttcagccatttgtgtgtttcttccttcactcctttcatcccaggaccactgggacctgtgcaaygaagtgagctgtgtgggctgcataactagtgctaggtttttattgtgtgacagcatgtttctgtttctcctccaggtgcacttatgcagtggggaatcat

SEQ ID NO: 69813 - DNA, 201 bp, Homo sapiens
gagctgtgcacacagatgtctgcagacaattacagggtaaccactttcctaagagaagcgtagagtttgagtaagaagaaaactaatattgtcactcttayttgaaaattttaaagtttctttatgatttgtgtaatttcaatccatttgtggagcactgactatgtacgcacactgtggtgatgtggacctcctgccctt

SEQ ID NO: 69814 - DNA, 201 bp, Homo sapiens
gcctgtcgtgcagtttgtgggattaatcttgacaaatagaattacttttgtattttgaaatctattaaattcaaatctgttttttaatattgctctcaggmcagaattaatatgttgtgtgttagtaataataagttaattttttaaagcatgtggtcatttaaaatggaagatatatgatcactaattatatgttaagct

SEQ ID NO: 69815 - DNA, 201 bp, Homo sapiens
gacgacacagcaagatcttgcttcggaaaaatgaaataaaagttcttatattttattaggcagatcaacagttggtaaagaaaggaaaaagcaaagttggkgacatgttggaaaaagcagcagagttactgatgagctgtttccgggtctgtgccagcgacacgtgagtaaggacttgaggaccgaccaccagacgctgtt

SEQ ID NO: 69816 - DNA, 201 bp, Homo sapiens
ggccccacagcattcacgctcactgtgcaagactggatgttttttgtgccaatgtggccacatagtttaggagcagaggcagtgtgtggtctcagtgtggrttccctaggcctcgacccagaccccagggcctgctgcttctggtgacccattctgcataagggagggcctctgcagctctgagcatctctgttctcttat

SEQ ID NO: 69817 - DNA, 201 bp, Homo sapiens
ttttttttttacaccacttacctcaagttctatacttgccaatcttttgatgtaagcccagggccttttctttaggctgtgtctgttttggcctaatcttwgcagacttaacattttccaatataagtttatttaaagttaaacaaggatataggcatttaagaaccaatttgatacgattatctttagaattttcttaat

SEQ ID NO: 69818 - DNA, 201 bp, Homo sapiens
aagttctatacttgccaatcttttgatgtaagcccagggccttttctttaggctgtgtctgttttggcctaatctttgcagacttaacattttccaatatmagtttatttaaagttaaacaaggatataggcatttaagaaccaatttgatacgattatctttagaattttcttaatcttttacaatttttcccccatacc

SEQ ID NO: 69819 - DNA, 201 bp, Homo sapiens
attatataaataattgttatgatataataggttttgtaatttgcattttaaggagacatgcttagtaatttgttttgccacctgtttttgttgtttttaartattttaaatggattgttattcattatagatcaacaaactccatttatgtaaacccctaattagagcaattgacagctcaaacctgaaagacgattacag

SEQ ID NO: 69820 - DNA, 201 bp, Homo sapiens
ttgatacgattatctttagaattttcttaatcttttacaatttttcccccatacctaattatttttttaacaaactcaagtgagccttttaaaaacatacmacttagcttatagagaaacaactgtttccttttgcattcatatttcattgatgagcttaaaagtacataactaccataacaggttcgggtagcaaaaata

SEQ ID NO: 69821 - DNA, 201 bp, Homo sapiens
gctactcgggaggctgaggcaggagaatgacgtgaacccgggaggcggagcttgcagtgagctgagatcgcgccactgcactccagcttggcgacagagcragactccatctcaaaaaagaaaaagaaaaaatgcattttttgtacatccaggagaatttgagattaccttgggcagtagcaaaggtacactttttagagg

SEQ ID NO: 69822 - DNA, 201 bp, Homo sapiens
tgtttcctccagggaaagttccaaatgctttagcacatcatctggtccatgtttacctgttaacttggcatcaccagtctgaaggtttatttcacttatgytgaatgcaccattgccccaccgaagtactcataacttaaaatataccatttaaccattttaaagtacacaattaagtacattcacaatattgcacaacca

SEQ ID NO: 69823 - DNA, 201 bp, Homo sapiens
acttttacgcattgttgctgcaaatgaggcagtttttagctggtgccgcggaggaaggatgttactcaagtagttaattgggattttcctggtttgttttytcttttatttttacccatcaggtaagacatcttttttcataatgttattttgtttgatgaatatgacttgatatgaataagttgatatgaatatgacttg

SEQ ID NO: 69824 - DNA, 201 bp, Homo sapiens
attcacaatattgcacaaccatcaccattatccagaattttttgtcaccccaaatggaaatgtcataagcattaagcagtcactccctggtcctccctccygagcgcttgtcaaccgctaatgtgctctctgtctgtatggatttgctgactctggtgatttcagtatgtggcttttgtgtgtctttcccttgcatcatgt

SEQ ID NO: 69825 - DNA, 201 bp, Homo sapiens
atcatttgcattagattctgccttctccatcctgtatttccttttgggatgtacatgtgacacacacacagacataaacacacatatttttcttgtttccyttcattcttatacaagacgcagcattctatacatactcttttacaacttgcttttttcacttaactgtatcttcctagaaattattgcatgtaaattcct

SEQ ID NO: 69826 - DNA, 201 bp, Homo sapiens
taaccaaaggccttttgcaaacaaacccgcccttttatctttttttttttttgagaaggagtcttgctcagtcgccgaggctggagtgcagtggcgcagtmttggctcactgcagcctctgcctcccgccacccttttatcttttaacgtgaaaacttgcacatgaaaacagtccagttttgccagttggctgtaaaagtt

SEQ ID NO: 69827 - DNA, 201 bp, Homo sapiens
gctggagtgcagtggcgcgatttctgctcactgcatgcaagctccgcctcctgggttcgcgccattctcctccctcagcctcccgagtacctgggactacrgatgcccaccaccacacccggctaatttttttgtatttttagtacagatggggtttcattgcgttagccaggagggtctcgatcttctgacctcatgatc

SEQ ID NO: 69828 - DNA, 201 bp, Homo sapiens
gtaatttttctcttcttttttctcccaaatcaagttatacagttttcctgcagttaactttttttttcatttaatcatcatattgtggacattttctcatsttactacatacagatctattttattctttttaacagcagccgagtatcgcattgtatgaatgtgacatctatttagctatttccattttccttttatttt

SEQ ID NO: 69829 - DNA, 201 bp, Homo sapiens
tgagatgtgtctggtatagggagcaaaagaaagatattgactattctttctgggttaacaccaacagatttatataaacatttgctcagatttccacactrttcatatagagggagaggttccattttgtggttaaccatttatggtatgtgttatttttatgaagtgagtggaacaacaacaaatgagcttattctgcat

SEQ ID NO: 69830 - DNA, 201 bp, Homo sapiens
ttgttagtcagaaaggctggcaagccaaggcccagcctggggttgtacatggagtttccatgtcatctgtggcgtagatgatgttgaggcagtattttctrtagaaaatcttgtggacatttggtaaagccctgtttcctcattgacaccctttatcatattggagtgtgttcctactggaagcagcatttttcttttgga

SEQ ID NO: 69831 - DNA, 201 bp, Homo sapiens
gtccatttccctagatatttattaaatactgttttttccttcagttgtcaattttgaacttttggttttaaaccttagataaaagaggtagaccaactacrgttcatttggggtgttctaatacataataatggtggtatttttaaatgccttgccaaactaaattttatgatttattaacaaactataggttaatactga

SEQ ID NO: 69832 - DNA, 201 bp, Homo sapiens
acatgcagtggattacttgggacttgagacccggaaacactgggccagttgctcatttctgcagttagaaaggaatgacagtgttttggaacagaagctcrtttcagctctttcacttgggtacttaaatttagcatggatctgaagactcgtgcagtacttagtaaggaagaacactggttaggaagaaggatcttactc

SEQ ID NO: 69833 - DNA, 201 bp, Homo sapiens
tagctgcatcattttacattttcaccagcaatgtatgagggttgcaatttcttcactttcttgtcaatgcttgtttttttccattctttttattatggccrtcctgctgggtgcggagtggtatcttcttgtggcaccccatgatctttcttgtcccaaagattttcttcattatgttccttttgccaagaacacctctct

SEQ ID NO: 69834 - DNA, 201 bp, Homo sapiens
caatattgcacaaccatcaccattatccagaattttttgtcaccccaaatggaaatgtcataagcattaagcagtcactccctggtcctccctcccgagcrcttgtcaaccgctaatgtgctctctgtctgtatggatttgctgactctggtgatttcagtatgtggcttttgtgtgtctttcccttgcatcatgttttca

SEQ ID NO: 69835 - DNA, 201 bp, Homo sapiens
gatcttagtatctgtctgtctaccttttagatgaaatccctaaacctgtggccagggctatgaagagaaacttagtttccataatacttgggcccaaatcrtcttgcacccatttgtgactttgaaaatgtcaggagctaggctatgatgtgacgttgagcagcagcttgtgaccttgcatggactggggcaggagggctg

SEQ ID NO: 69836 - DNA, 201 bp, Homo sapiens
tacttgagcctaatgagatacagatatttgtaatgtgagcttataccttttttccttcaagaacttactattgttgcaacataaatctgctcaagggtgakctacattccttaaaatttagattcttattctttacttttatcgtacgtagcattatttgaactttgtatgccatatcttccttaatacagtacatcattc

SEQ ID NO: 69837 - DNA, 201 bp, Homo sapiens
ccagacgctgttggtggtgttttcattgcagcgttcaccctttctggcctgtgtttattgttgacacatatttcatttctacacatgctataatcccacarccattgttatttttgctttaaaaagttgattgttttgtaaaggaaataagagctgagggaaaaaagagtcttcatttgcccacatttgaccatgcctgga

SEQ ID NO: 69838 - DNA, 201 bp, Homo sapiens
ctcatgctggaagacaaagaggagcccactacatggcaagagaggaggcaggagatagaaggggaggcgccaggctcttccacaaccagctgtctgggaaygctcacaggagctcagagcgagaactcattcattatggcaaggacagcaccaagccattcatgaggggtccacccccatgacccaaaaacctcccattag

SEQ ID NO: 69839 - DNA, 201 bp, Homo sapiens
tttgtgtgtctaaacagatctaaacacagaaaagatgcagtaaaaatacagtgtgagactccgtagggccccatctcacatgtggtcaagtgtgagactcygtagggccccatctcacatgtggtcaagtgtgagactccgtagggccccatctcacatgtggtcaagtgtgagactctgtagggccccatctcacatgtg

SEQ ID NO: 69840 - DNA, 201 bp, Homo sapiens
atgtggtcaagtgtgagactccgtagggccccatctcacatgtggtcaagtgtgagactccgtagggccccatctcacatgtggtcaagtgtgagactctrtagggccccatctcacatgtggtcaagtgtgagactctgtagggccccatctcacatgtggtcatctgtagttgaccgaaatgttgtgtaacatgtgact

SEQ ID NO: 69841 - DNA, 201 bp, Homo sapiens
attgacgaagttcagtgtattctggctaacttgatatacatggtgtgtgagtcctggttttaatttaagcagctactcacagcaagattcagcccagaatytgaagcttcagtgtggtggtgttaaaattgttaaaaggccttctgctttttttttgatagaactaattttagcccaggaaataccattcaccagggcctt

SEQ ID NO: 69842 - DNA, 201 bp, Homo sapiens
ctgggacctgtgcaatgaagtgagctgtgtgggctgcataactagtgctaggtttttattgtgtgacagcatgtttctgtttctcctccaggtgcacttaygcagtggggaatcatgacttcatagaggcatacaagtgccagaccgtgatagtccaatatcctttgtcgttcatggcagctgtcccgcatagaacacatg

SEQ ID NO: 69843 - DNA, 201 bp, Homo sapiens
ctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctg

SEQ ID NO: 69844 - DNA, 201 bp, Homo sapiens
gtcggtcggtgtttaggaggtttagaggtagatacatctgaatgctgaccccgacttcaaccctcgccggctgagctgtttccccctccgtgccttgaggrtgataatacgataagatagtgcatgtcaagtgcttaggacatattgagcgctcggagttagttcaaacttggttcttcgacccctagccctgtctccgga

SEQ ID NO: 69845 - DNA, 201 bp, Homo sapiens
tcggtcggtgtttaggaggtttagaggtagatacatctgaatgctgaccccgacttcaaccctcgccggctgagctgtttccccctccgtgccttgaggakgataatacgataagatagtgcatgtcaagtgcttaggacatattgagcgctcggagttagttcaaacttggttcttcgacccctagccctgtctccggat

SEQ ID NO: 69846 - DNA, 201 bp, Homo sapiens
aaggactttaaaacttgggctggattctgcgtggtggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggt

SEQ ID NO: 69847 - DNA, 201 bp, Homo sapiens
ccacgtcccagagacaccctcgaggtttagactctgggagtgcgcctttaaaccggaggcctgggcacgacgcgggacgcctgggttctttccctggctgsagcctctcctcctcctccccgccctctgagaacccttgactcgacataggggcgctaagatgtcagggagttggctccccaggctcagcccgcgtttccc

SEQ ID NO: 69848 - DNA, 201 bp, Homo sapiens
tggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcac

SEQ ID NO: 69849 - DNA, 201 bp, Homo sapiens
ggggcgtgacctgggtcttggggcggccggccccgcctgcctccctctcggtcccggtagactagacggaagtgggacagagtagaagtcaaaggtgcctkagcgggtggggctgttgatcgcactttgaggggtgggagatggaggtggcagggggactgaattcaaggggagggaccctccggggctgtcactgctgca

SEQ ID NO: 69850 - DNA, 201 bp, Homo sapiens
ctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcacgacgcgggacgcctgggttctt

SEQ ID NO: 69851 - DNA, 201 bp, Homo sapiens; identical to SEQ ID NO: 51254

SEQ ID NO: 69852 - DNA, 201 bp, Homo sapiens
agatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgttggagggagagaggggtcaagatcgccttctctc

SEQ ID NO: 69853 - DNA, 201 bp, Homo sapiens; identical to SEQ ID NO: 51257

SEQ ID NO: 69854 - DNA, 201 bp, Homo sapiens
gcgcccccgggggccctcaacatcggcctgtcgagcaacaacagcacactgagcgtggcaggcgccatgggaagccacggcggcgagtacgagtgcgcagscaccaacgcgcacgggcgccacgcgcggcgcatcacggtgcgcgtggccggtaagtggcagctggggagaggcggggcgaggtatctgagagggggcgtg

SEQ ID NO: 69855 - DNA, 201 bp, Homo sapiens
ggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgcctcgactagcgtgacacctccttggatcggcgtccaagggttatgcaggg

SEQ ID NO: 69856 - DNA, 201 bp, Homo sapiens
ggggcgaggtatctgagagggggcgtgacctgggtcttggggcggccggccccgcctgcctccctctcggtcccggtagactagacggaagtgggacagartagaagtcaaaggtgccttagcgggtggggctgttgatcgcactttgaggggtgggagatggaggtggcagggggactgaattcaaggggagggaccctc

SEQ ID NO: 69857 - DNA, 201 bp, Homo sapiens
cgcgcccccgggggccctcaacatcggcctgtcgagcaacaacagcacactgagcgtggcaggcgccatgggaagccacggcggcgagtacgagtgcgcasccaccaacgcgcacgggcgccacgcgcggcgcatcacggtgcgcgtggccggtaagtggcagctggggagaggcggggcgaggtatctgagagggggcgt

SEQ ID NO: 69858 - DNA, 201 bp, Homo sapiens
tgcctcgccccctggaggcgtgcgcccaggaggaaacttcacgttgacctgccgcgcggaggcctggcctccagcccagatcagctggcgcgcgcccccgrgggccctcaacatcggcctgtcgagcaacaacagcacactgagcgtggcaggcgccatgggaagccacggcggcgagtacgagtgcgcagccaccaacgc

SEQ ID NO: 69859 - DNA, 201 bp, Homo sapiens; identical to SEQ ID NO: 51280

SEQ ID NO: 69860 - DNA, 201 bp, Homo sapiens
caaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtc

SEQ ID NO: 69861 - DNA, 201 bp, Homo sapiens
ccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgc

SEQ ID NO: 69862 - DNA, 201 bp, Homo sapiens
accttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgggggccctcaacatcggcctgtcgagcaacaacagcacactgagcgtggcaggcgcca

SEQ ID NO: 69863 - DNA, 201 bp, Homo sapiens; identical to SEQ ID NO: 51281

SEQ ID NO: 69864 - DNA, 201 bp, Homo sapiens
cgggcgctctcaggcacttaccgctgcaaggcggccaatgatcaaggcgaggcggtcaaggacgtaacgctaacggtggagtgtgagtgggggtgcgcagrgtgcatttctatctggttcaaggtctggagggtggccagcctccagggaagagtaggagtagggtatgaggtgtccctttgggtgaggttttgggaaagg

SEQ ID NO: 69865 - DNA, 201 bp, Homo sapiens; identical to SEQ ID NO: 51283

SEQ ID NO: 69866 - DNA, 201 bp, Homo sapiens
gagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcc

SEQ ID NO: 69867 - DNA, 201 bp, Homo sapiens
ccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccgaggcggcggggggcgcggccgagtcgccggcggagggcgaggtcttcg

SEQ ID NO: 69868 - DNA, 201 bp, Homo sapiens
ccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctc

SEQ ID NO: 69869 - DNA, 201 bp, Homo sapiens
cgagtacaacgtgcaggaggccgagagctcaggcgaggccgtgtgtctgaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggg

SEQ ID NO: 69870 - DNA, 201 bp, Homo sapiens
gtaagagccccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagccccta

SEQ ID NO: 69871 - DNA, 201 bp, Homo sapiens
catcggcgctttggagaccatggctctctgctaccacgtcccagagacaccctcgaggtttagactctgggagtgcgcctttaaaccggaggcctgggcasgacgcgggacgcctgggttctttccctggctgcagcctctcctcctcctccccgccctctgagaacccttgactcgacataggggcgctaagatgtcagg

SEQ ID NO: 69872 - DNA, 201 bp, Homo sapiens; identical to SEQ ID NO: 51288

SEQ ID NO: 69873 - DNA, 201 bp, Homo sapiens
tcatcgaggggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcc

SEQ ID NO: 69874 - DNA, 201 bp, Homo sapiens; identical to SEQ ID NO: 51289

SEQ ID NO: 69875 - DNA, 201 bp, Homo sapiens
ggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccct

SEQ ID NO: 69876 - DNA, 201 bp, Homo sapiens
accaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagctt

SEQ ID NO: 69877 - DNA, 201 bp, Homo sapiens
ctctcaggcacttaccgctgcaaggcggccaatgatcaaggcgaggcggtcaaggacgtaacgctaacggtggagtgtgagtgggggtgcgcagggtgcayttctatctggttcaaggtctggagggtggccagcctccagggaagagtaggagtagggtatgaggtgtccctttgggtgaggttttgggaaagggaagag

SEQ ID NO: 69878 - DNA, 201 bp, Homo sapiens
acacgggggcttatttattgctttatttatttacttattcatttatttatgtattcaactccaagggcgtcacccccattttctacccatcccctcaataragtttttataaaggaactccctgtctccgcttctgtttctgcaaggtggaacaagcccagggttccagtcgtgacctcccgagttattcattcaaaaagc

SEQ ID NO: 69879 - DNA, 201 bp, Homo sapiens
ggtaagtggcagctggggagaggcggggcgaggtatctgagagggggcgtgacctgggtcttggggcggccggccccgcctgcctccctctcggtcccggkagactagacggaagtgggacagagtagaagtcaaaggtgccttagcgggtggggctgttgatcgcactttgaggggtgggagatggaggtggcaggggga

SEQ ID NO: 69880 - DNA, 201 bp, Homo sapiens
ttgggcggagtcgtggaaaggcgggcagtccagagtgtttaagtttttagacgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtca

SEQ ID NO: 69881 - DNA, 201 bp, Homo sapiens
acgccccccagactcacacgggggcttatttattgctttatttatttacttattcatttatttatgtattcaactccaagggcgtcacccccattttctasccatcccctcaataaagtttttataaaggaactccctgtctccgcttctgtttctgcaaggtggaacaagcccagggttccagtcgtgacctcccgagtt

SEQ ID NO: 69882 - DNA, 201 bp, Homo sapiens
ttatttattgctttatttatttacttattcatttatttatgtattcaactccaagggcgtcacccccattttctacccatcccctcaataaagtttttatraaggaactccctgtctccgcttctgtttctgcaaggtggaacaagcccagggttccagtcgtgacctcccgagttattcattcaaaaagcgatttttgag

SEQ ID NO: 69883 - DNA, 201 bp, Homo sapiens
gcagctggggagaggcggggcgaggtatctgagagggggcgtgacctgggtcttggggcggccggccccgcctgcctccctctcggtcccggtagactagrcggaagtgggacagagtagaagtcaaaggtgccttagcgggtggggctgttgatcgcactttgaggggtgggagatggaggtggcagggggactgaattc

SEQ ID NO: 69884 - DNA, 201 bp, Homo sapiens
ctggggagaggcggggcgaggtatctgagagggggcgtgacctgggtcttggggcggccggccccgcctgcctccctctcggtcccggtagactagacggwagtgggacagagtagaagtcaaaggtgccttagcgggtggggctgttgatcgcactttgaggggtgggagatggaggtggcagggggactgaattcaagg

SEQ ID NO: 69885 - DNA, 201 bp, Homo sapiens
ggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacggtggaat

SEQ ID NO: 69886 - DNA, 201 bp, Homo sapiens
gtggcaggcgccatgggaagccacggcggcgagtacgagtgcgcagccaccaacgcgcacgggcgccacgcgcggcgcatcacggtgcgcgtggccggtamgtggcagctggggagaggcggggcgaggtatctgagagggggcgtgacctgggtcttggggcggccggccccgcctgcctccctctcggtcccggtagac

SEQ ID NO: 69887 - DNA, 201 bp, Homo sapiens
cgtggcaggcgccatgggaagccacggcggcgagtacgagtgcgcagccaccaacgcgcacgggcgccacgcgcggcgcatcacggtgcgcgtggccggtmagtggcagctggggagaggcggggcgaggtatctgagagggggcgtgacctgggtcttggggcggccggccccgcctgcctccctctcggtcccggtaga

SEQ ID NO: 69888 - DNA, 201 bp, Homo sapiens
gcaacagaagttggaactggacacaagatcatgccacaaaagaccacatttcttagctccccatgcagctctgggtaccttgtgagtagattctggtcaaygggaggtgattacaagtgaaaggaatgtgcaaagccttttccttcccatttttctattggctgaaacaaggatactttcttctgagccacttttgaccat

SEQ ID NO: 69889 - DNA, 201 bp, Homo sapiens
caaacctttggctttatcctaactcaaaacaacactttaaccctttaatctaggcaaaaaaaatccacatttccttgactgtttatatatatatatatatattttttttttaccaaaaacacatttcactttccttacatgccttacacatagaactgtttctttagtagtcttaactatatgttacaatgttaactctta

SEQ ID NO: 69890 - DNA, 201 bp, Homo sapiens
aaagcttaggcaaatttctctcattggaaaattgagctcaacctgtaaaaggcaggagattccaggaaaggaagattcagtgagaagcagatgaaagtgakgaaaagctgacaactaacaacgtagcacaacctgaaagcacctaaattcctacatttacctcctcattatgtaaccgcccagtggattcaccttgtccgc

SEQ ID NO: 69891 - DNA, 201 bp, Homo sapiens
gtagacaaggtgtgaggccagttttcccaaggggcttttattggatctataagtcaagtttaattccttaaaggaaaacacaccattccagtcaaagcctwggtaaaaataaccagtttttccaattgtgtcctattgcaaaagaaacagattcttattgcactatgttgccttaagatactcacaaatagtttccaaatt

SEQ ID NO: 69892 - DNA, 201 bp, Homo sapiens
ggtgttaaggcaaagccaagttcattacataccccagtaaaggggattctgagactgaggagtgcctcagaaaagagggcaaatgtggtggtcattgaatrtgttgaaccctgagtgagtgagtttttgatgtgggggtggattagaattgggaaagtttgggacatattagggtcaggggacacagggaggtgaggattt

SEQ ID NO: 69893 - DNA, 201 bp, Homo sapiens
agcaagttttatgagagctgggccacagccttgctcacagctatattcccggtgcttggcatcttggtgcttgttgaatctttgctgatgaatgacccaaygcgtgaatgcatcctcagcacctctggcttctcagggcctcgcgccaggctcctgggggtcctggccctgggcgggttaccctcctggtgtcactttttc

SEQ ID NO: 69894 - DNA, 201 bp, Homo sapiens
ccacaaccttgccaacaccgatcgtctttgttttttcttttctttttttctttttttttgataaaagccatcctgagagatgtgaggtggtatctcattcctggttttgatttgtatttttctgatgatgagtgacatcttttcagatacccattggtcatatgcatgtcttcttttgactaatgtctatccaggttcttt

SEQ ID NO: 69895 - DNA, 201 bp, Homo sapiens
gctggcttatttattaaagattttacttaagttacataaacttgaaaaagcatttgactaatcttttctttcttattatctaatttaagtggtttttttttgagatggagtctaactctgtcacccaggctggagtgcagtggtgggatctcggttcactgcaacctctgccccccaggttcaagcgattctcctgcctca

SEQ ID NO: 69896 - DNA, 201 bp, Homo sapiens
ttagaaaaagacataattcataatttgattttggaaagttggtcaaatataaaaggtttaaaacacttgatattacaaaataggattacaggtcattgtamagtcatttatttaaccaaagtgataattcaaggatttcaaaaaagcgaaaaccttcattctttgagagaggagacttcattttctaaacaaggggcccta

SEQ ID NO: 69897 - DNA, 201 bp, Homo sapiens
gatattttatttactccaaccccaaaagtaccatcagtctcagccttctaccttgggtttggaaattcacactcaatttttctgttgattgtcatgtaaaygtttgataaggaagcataagcattcatgagaagactatatcttttttctaaaagttccaataaaatgctgcagtatatcactttaaaatgattaaagata

SEQ ID NO: 69898 - DNA, 201 bp, Homo sapiens
caccttatagtatttggcagggataagtatgaaattgcctgattaataaatgcaaacaaaaatgtatgctggcaattcttaagacatttctaatataactytaccaataattttaaagctggcttatttattaaagattttacttaagttacataaacttgaaaaagcatttgactaatcttttctttcttattatctaat

SEQ ID NO: 69899 - DNA, 201 bp, Homo sapiens
taacctttattaaggagttggttaatgctttaagaaaaccttgttaatctgacacagggctccatatactggttttgcatcaatgtgcctttgacattaayaattaatttgtagagaaactgaacttattttatctttcaaaatgggcccttacaatcttatgcgcccacctcttcccccatagtccctcagtcttgagga

SEQ ID NO: 69900 - DNA, 201 bp, Homo sapiens; identical to SEQ ID NO: 49012

SEQ ID NO: 69901 - DNA, 201 bp, Homo sapiens
tgctacagagaacatctctggaattctaatagattcctacagccctcttgaaaaaacagtttatgtctgatgttaactagtctaagttaaaaatgtgctcrggctaaagaaagtgtctgccccacaaatgtggccacccttcagctcactgatgcttttgtgcaaaaagtcgtggtccggatatctgaatcctcctcctgc

SEQ ID NO: 69902 - DNA, 201 bp, Homo sapiens
tttctttacatatttttttagttcctggttccttttaccttgttttatacataactctgaaataagctttaaattaggcaaaacttgttcactttttttttataaaaaaggacacacttctttttcttctttctttttttttttttaagcagaaatgttttcccacaatatatatttattggaaaacacccaaatactgaa

SEQ ID NO: 69903 - DNA, 201 bp, Homo sapiens
gggcctgtcaagcctcatcagctgtcttcctttgcttctacaaaagccactaaaccctgttggatttaggggctttctagatagcatttcccttccacagkaacagaccatgcactggacatattaaaatcacaacccagccctcaccacccgtccttccccttcaaggccaggccaaggtccagctgaggtccacccatg

SEQ ID NO: 69904 - DNA, 201 bp, Homo sapiens
taccagatagaaacttagatccacacaaagaggtgaggaggactgggaaaaggtaaaaatacaatttgtgggtttaaaacattttaaaattctctaaattrtaactaattgtctaaagcaaagagggtagcaatatattgtgtgtttacaacataattaaaagtgaaatgtattgtagcaataatacaaagtgtgggaaga

SEQ ID NO: 69905 - DNA, 201 bp, Homo sapiens
tgtcccactttcttcatccagctggggccttccacgggagagcactgaaggtatttgcacccaatgcttcataaagccagccagggcactcatttttaagytcacagtgcgccaccttctatcttcgggttgtttatggcctcttggttataggatgtaaacatcccccatgggagatgtgcaggttacccacctgatcaa

SEQ ID NO: 69906 - DNA, 201 bp, Homo sapiens; identical to SEQ ID NO: 49016

SEQ ID NO: 69907 - DNA, 201 bp, Homo sapiens
caaggaattcagtttacctcagcaagtgctaatgcagctctagttttagttttcattctgggatggaacaacatagccccagttgttgagggtctctctgygagtatctttctggtggcacaagcagtgacccctaggcaaattgatgggctcatctggattagtccactgcattttttaggatggccaaagctgctttct

SEQ ID NO: 69908 - DNA, 201 bp, Homo sapiens
tgctgattgattaaaaggataagcctaggtgctgtagatgttgattcgtagacactggggggtggagcttggtgctggcatccacagtgacctgagtgatkcttcacaagcactgagaatcatgctgagtcttgaatttttttaatattcactttcagcaattgattaatccacccagcactgttagagaggtgtgtggct

SEQ ID NO: 69909 - DNA, 201 bp, Homo sapiens
gaaagataatctggaaaatccccccatcttaacctgattagcagccttaattccctttaccatgtggtgtaacatattcgcatatgtaacattaccatgtrgtgtgacatattcacaggttgcagggattcatgtgtagacgtctttaggggctgttattctgtctactacaatgtttgactagtgtctatagagtgaatt

SEQ ID NO: 69910 - DNA, 201 bp, Homo sapiens
gcgaaaattttcaagaaactctggaaaacctcctaccaaacctggtgcttgataagaagcctagatgccactgtgaaccttgtgtctgctgtggcccccawgacctgaggaggattgcctctcttcactgtcttccaaagcttaggcaaatttctctcattggaaaattgagctcaacctgtaaaaggcaggagattccag

SEQ ID NO: 69911 - DNA, 201 bp, Homo sapiens
tatactaaaaatatttgtgtatttaaatattctttttctacatgacttcaaaacaacacatttgtgtacttaatacatgaaatatttattatacagacacrtaaaagggaatgtattgtatatactgttttacattggactttttccgcttattacattgtgaatatctttttacattattaattattgctctaagacatc

SEQ ID NO: 69912 - DNA, 201 bp, Homo sapiens
aggaaattctgacacatgctactcacgaagaaccccaaggacattatgctgagtgaaataagccagtcacaaaaacacaaaagctgtatgattcacttgtrtgacgtaccggagttgtcaaattcatagagataggaagtagaatggtggttgtcaggggctgggggtaggggaaaatggggagtaatgggtatcacattt

SEQ ID NO: 69913 - DNA, 201 bp, Homo sapiens
aatgtgtgttcaaaaagcaggagtccctatgactcagcaattccacttccaaacatacccaacagaatcgaaagcagggactcaaagagatagttgcatamcgtgttcatggcagcattacttacaatagccaaaaggtggaacttaaatgtccatctacagatgaatggataaacaaaatgtgacatagacacacaatgg

SEQ ID NO: 69914 - DNA, 201 bp, Homo sapiens
tgcacctgcctcagcctcccaaagtgctgggattacaggtgtgagccacctcacctatgacgggcattttactgaagaagaaaccaaaggctttcccaaartcacacagcaatgactgacagaaccgaaaatagaacccaggtcttctaactccacatctggtgccttttcaggacctctgaagttagagacaaataaaga

SEQ ID NO: 69915 - DNA, 201 bp, Homo sapiens
gctgcttctgactggtggggacacttgagggtgagcactcttgctcagtctcttacttttctcgcttgctccactctggtggtgacactatcaggtcaaayatggaaagtctttagtccttagttccattggctgaagcagaacagtcctccgacactgtgattcatacgcaccctaactgggcatgtgcagagccagctg

SEQ ID NO: 69916 - DNA, 201 bp, Homo sapiens
caggagatagttaagaattgagggtttgaggtattagatatatatttctaaacatacgttaaactgaatatgtacctattaaaaagaaaagataaaacgtwctacctaagatcatctcacgtaccactttggaaactcctgtcctaccttaccggccccttaaaagcaggacagtgactcatgcacagcctgctttctacc

SEQ ID NO: 69917 - DNA, 201 bp, Homo sapiens
ttggcagaacattctctttaacgagcagattcattcattttctgggaaacatactagcgttttgcctctatcacactaaaagaactggctggtgcaatcarttccacagaacacccatcaattcagttaaacaaccagtggggtggaaaacccccagaaatcaatagtagttgtttcactgaattgatgggttactgcgag

SEQ ID NO: 69918 - DNA, 201 bp, Homo sapiens
cagcttatcagcatattgacatgcaatgaaagccccttaaatgcttcccaatccctatgcagaagaagcggagaaggaaaaccactgtcattggaaaaaawtatttggcagaacattctctttaacgagcagattcattcattttctgggaaacatactagcgttttgcctctatcacactaaaagaactggctggtgcaa

SEQ ID NO: 69919 - DNA, 201 bp, Homo sapiens
gtttccctagccatgtggaactgtaagtccaattaaacctctttttgttcccagtttcagtatgtctttatcagcagcgtcaaaatgaactaatacactgwcttacatatgagttgccagaaacgagacacttcatgctgtataaaatgcataaaaatgcaaaatatacattgcatattcggagtcagctgacttaatgga

SEQ ID NO: 69920 - DNA, 201 bp, Homo sapiens
actggatcaagacatatggctttcatgctctggaatgaggctttctaacaggtcccattgacatgtgaatggcatccaaggccagggtaccaaatggtctsttaccccagccccctggagatacccagagcctagaagaccacccatgtgggtcgatgggaggaggaagtcaggacacactagaagcgaggtgagcctcgg

SEQ ID NO: 69921 - DNA, 201 bp, Homo sapiens
catgctattctcgagatagtgagtaagtctcacaagatctgatgggtttatcaggggtttctgcttttgctccttctctcattctctcttgctgctgccaygtaagaagtatctttcaccctccgccatgattgtgagagtttccctagccatgtggaactgtaagtccaattaaacctctttttgttcccagtttcagta

SEQ ID NO: 69922 - DNA, 201 bp, Homo sapiens
actgggctaaaaatcaaggtgtccgcagggttcagttccttctagaggctctagggaagaatctgagtttttgtttgtttgtttgtttgttttttcttttytttttccttttccagcttttggggctacctgcatttcttggcttctggccccttcctctgtcttgaaagtcagcaatggtgtgctgagtctctctcacat

SEQ ID NO: 69923 - DNA, 201 bp, Homo sapiens
tgacttctggcatctcagaagacattggtagccttttgattctagtcatccatacacaggcaagatctgcatagaaccaaggaattcagtttacctcagcragtgctaatgcagctctagttttagttttcattctgggatggaacaacatagccccagttgttgagggtctctctgcgagtatctttctggtggcacaag

SEQ ID NO: 69924 - DNA, 201 bp, Homo sapiens
gtataaacagcatgaagccaattacattagttttttaaaattttgtaaacaatcttcattatataatataacttccataagtcttttataacctttattaaggagttggttaatgctttaagaaaaccttgttaatctgacacagggctccatatactggttttgcatcaatgtgcctttgacattaataattaatttgta

SEQ ID NO: 69925 - DNA, 201 bp, Homo sapiens
accacaggtcacaaaccctgtatagggactgtgtacacaaaatatgaggccagtttttccaagggctttattggctccataaatcaagtttgattccttaraggaaagcacatcattccagtcaaagccttggtaaaataaccagtttctccagttgggtcctgttacaaatgaaaacagattcttattgcacttatgcaa

SEQ ID NO: 69926 - DNA, 201 bp, Homo sapiens
attctccagcctcagcctcccgagtagctgggattacaggcacccgccatcatgcccggctaatttttgtgtttttgtagagatggggttccactatgttrgccaggctcgtctcgaactcctgacctcaggtgatccacccacctcggcctcccaaagtactgggattacaggcatgagccaccatacctggcctcaccc

SEQ ID NO: 69927 - DNA, 201 bp, Homo sapiens
agtttatgtctgatgttaactagtctaagttaaaaatgtgctcaggctaaagaaagtgtctgccccacaaatgtggccacccttcagctcactgatgcttytgtgcaaaaagtcgtggtccggatatctgaatcctcctcctgcctccacaatgggctgctatccggtaacggctgtgaggtcccattaccgcagggcgag

SEQ ID NO: 69928 - DNA, 201 bp, Homo sapiens
aggtttcctttgcaaacattttcacttattaccctttatcacctttgctaattaaggaagatacagaaaccagatttttagggttttttttttttttttttcaatttcagcctttggccacttcctataaaagatttccctctgctttgaataaaatttctaagcagccttcagagccaaattaaatgatttggaattctc

SEQ ID NO: 69929 - DNA, 201 bp, Homo sapiens
aaagtgaaaaggaaagaaaataactgagcaggcaaagctctgtcccactttcttcatccagctggggccttccacgggagagcactgaaggtatttgcacycaatgcttcataaagccagccagggcactcatttttaagctcacagtgcgccaccttctatcttcgggttgtttatggcctcttggttataggatgtaaa

SEQ ID NO: 69930 - DNA, 201 bp, Homo sapiens
ttagcagccttaattccctttaccatgtggtgtaacatattcgcatatgtaacattaccatgtggtgtgacatattcacaggttgcagggattcatgtgtrgacgtctttaggggctgttattctgtctactacaatgtttgactagtgtctatagagtgaatttgtgcctgtgattggccttatgcacacagctcaggcc

SEQ ID NO: 69931 - DNA, 201 bp, Homo sapiens; identical to SEQ ID NO: 48947

SEQ ID NO: 69932 - DNA, 201 bp, Homo sapiens
gctaaaaatcaaggtgtccgcagggttcagttccttctagaggctctagggaagaatctgagtttttgtttgtttgtttgtttgttttttcttttttttttccttttccagcttttggggctacctgcatttcttggcttctggccccttcctctgtcttgaaagtcagcaatggtgtgctgagtctctctcacatttcat

SEQ ID NO: 69933 - DNA, 201 bp, Homo sapiens
agtttccctagccatgtggaactgtaagtccaattaaacctctttttgttcccagtttcagtatgtctttatcagcagcgtcaaaatgaactaatacactrtcttacatatgagttgccagaaacgagacacttcatgctgtataaaatgcataaaaatgcaaaatatacattgcatattcggagtcagctgacttaatgg

SEQ ID NO: 69934 - DNA, 201 bp, Homo sapiens
tagggtaaacagacttaactggggaagcctctattgtccctagtatttaccctatgacctaatgctccaaagtaagaactggctgccttcagtctcttcarttattacaagctatgtaacctttcggccttccaaaaggtttgtgactatttcctataacattccctaatatttccctttaatatttcttccaccatcctg

SEQ ID NO: 69935 - DNA, 201 bp, Homo sapiens
cgatcttttataacgagttttataatgaccatgtattgactgggccagcagagcccgggaagtgggacctggaagaacaggctcttcagtgtcagccaagragctcacttgtcagtgtttcagagtgatcctgggatggtaattgctgctgagctttgcagaaatggcaaggtgtgggaaagtgacacaagtcttgaatcc

SEQ ID NO: 69936 - DNA, 201 bp, Homo sapiens
ccattagggggcagtatgcctggtcgacatccacctgagagggtcatctagctcaaaggttagttaatggaggtagggtaaacagacttaactggggaagmctctattgtccctagtatttaccctatgacctaatgctccaaagtaagaactggctgccttcagtctcttcaattattacaagctatgtaacctttcggc

SEQ ID NO: 69937 - DNA, 201 bp, Homo sapiens
tggcttaattaatctgacacattctgagccgcggcgcaatagtcctcagatgctttatgcggccatatccccagcctggggaagggtggctaagcccatgyttattactcatttatttattattaactttattttaggttcaggggtacacatgcaggtttgttatataggtaaactgtgtgtcacaagggtttggtgtac

SEQ ID NO: 69938 - DNA, 201 bp, Homo sapiens
ttgacgtgtctcagactgggtccctgagaagctgtccgctttcagcgcagcatgaggtatttggtagagttgaaaatgccaattgtaacccagtcaacccrctcagcacactgcctgctggtgccgtgccagtgccaaacagacctgtggcttcccaggggacaggtctcaggacactctcagagcttgagtttctctgcg

SEQ ID NO: 69939 - DNA, 201 bp, Homo sapiens
gggatcttttccagccatcccatcagctctcaagtttcctttttcagggaggaaaaagccccctaagtcccatgatcctgtacatgcctaattctgtcacyggcagctgccagcatgaggtattgctcctcatacttgagggcattagctgcgggggtctgcctgcagaccctgacccaaatgacagatgaataaaacgta

SEQ ID NO: 69940 - DNA, 201 bp, Homo sapiens
ttacaggcacccgccatcatgcccggctaatttttgtgtttttgtagagatggggttccactatgttggccaggctcgtctcgaactcctgacctcaggtratccacccacctcggcctcccaaagtactgggattacaggcatgagccaccatacctggcctcaccccttgcgtttaaaatgagtcccacagagccctgg

SEQ ID NO: 69941 - DNA, 201 bp, Homo sapiens; identical to SEQ ID NO: 48951

SEQ ID NO: 69942 - DNA, 201 bp, Homo sapiens
cacttctaaatgtccccatctctgtggtggggacaataatcatacctgataggtaaagttataggattcagtgagatgacacatgtaaaagcccagcataygtagtcagtgcttgcaaatattaaccatgattattactgtaattctcaagtggaacctctacagatgaaaccatttacattattagtaacaatggcaact

SEQ ID NO: 69943 - DNA, 201 bp, Homo sapiens
tttatgaccttaaagcatttagcaaacttaatatctgactgcataatttagaccaaatgtctttgttttaccaataatctttaaggctgtttttatttccsaaagattactaaagtcatgtgaactaaaaggcattacactttttacttttctgaaaaaatattttatttaagcacttatttttaaaccaattaatcaaag

SEQ ID NO: 69944 - DNA, 201 bp, Homo sapiens
ctcagttaatttagaaagtttattttgccaaggttgagaacttgctcgtgacacagcctcaggaagtcctgagacatgtgcccaaggtggtcagagcacarcttggttttatacattgaaggagacatgagacgtcaatcaatatatgttagaagtacattggttcggtctggaaaggtgggataacttgaagcaaaggca

SEQ ID NO: 69945 - DNA, 201 bp, Homo sapiens
gctcgtctcgaactcctgacctcaggtgatccacccacctcggcctcccaaagtactgggattacaggcatgagccaccatacctggcctcaccccttgcrtttaaaatgagtcccacagagccctggaggatcacagcagccactgtcccatggtcagcagagccatgactgggacccaggcccctgccccttctctcac

SEQ ID NO: 69946 - DNA, 201 bp, Homo sapiens
caaatccttctctgccacgactaaaagactcagaatctgatttgctccatagccatttgttgagccttacggttctgtcttgacaaagacgagtcagagtyactggggttctctggaggactcagccagcctaggttttagattcaagttgacctgggttcaccttgcttcttattttgggggtgggttgggggttatctg

SEQ ID NO: 69947 - DNA, 201 bp, Homo sapiens
ctagtagtcagtgctgagctgtggacatgggtctgttccgcagggtggggtttgttaaagttgtcaagtataaggcctactgtaagagataccaagtgacwtttagaagacagtgtgagggtaaaactgattactatgcttggaaacacttagtggtacaggataaaaataagtctaacacacacaaatacagaatgatta

SEQ ID NO: 69948 - DNA, 201 bp, Homo sapiens
aatcaagatgaaaaatccatgaacccactgtgggatgatgtgatttttagttttctggctttcctaaaacttccagagtttttacaatggatacatactasttttgtaatcagataaaagtgtgttattttaaaatgctaatatgaaagaaagaggaaaggaggaggaaggaaaaaggggaggaaagagaaagggaagggc

SEQ ID NO: 69949 - DNA, 201 bp, Homo sapiens
acaagctcaccttcccaagggagtttctgggagcagtggtgttggtggatggtgggtggaaggaacatggtgtgagcgtgcacaggatgctgcaggtgtgyggatgcctgctctcctgagggctggtgtagaggaccccaggaaggcttccctggcttttgtcccctgtcctcaagatagcttctgtcgtttgtaaaactc

SEQ ID NO: 69950 - DNA, 201 bp, Homo sapiens
catccatggcacatttgtaagtaacagaagccagtttcaaaaccaaaccctgtgcattgtgggtctttttggagaaggcatatatacatatgccagaacaygaaatcaagatgaaaaatccatgaacccactgtgggatgatgtgatttttagttttctggctttcctaaaacttccagagtttttacaatggatacatac

SEQ ID NO: 69951 - DNA, 201 bp, Homo sapiens
atacaccagggcatgccatacacctgggcacaccatacaccagggcatgccatatgcctgagcacactgtagacctgggcatactgtactcttgggcatgmcgtacacctgggcacactgtacaccagggcatgctgtatgcctgggcacaccatacaccagagcatgccatacacttgggcacacagtacacctgggcat

SEQ ID NO: 69952 - DNA, 201 bp, Homo sapiens
gggcatactgtactcttgggcatgccgtacacctgggcacactgtacaccagggcatgctgtatgcctgggcacaccatacaccagagcatgccatacacytgggcacacagtacacctgggcatactgtacccttgggcatgccacacacctaggcatgctgtattcctgggcatactatacccctgggcatactgtatg

SEQ ID NO: 69953 - DNA, 201 bp, Homo sapiens
aagactcactgaggctaatccaacagcaaatgcctggtggcccaacacttggagccccacaaagcaatcagtgtccttccatcgattgaggaggtgaagaygtgaggaagcgtgaggtaggaggcctgtcgtgcccctctccaggtgtcttctggaggactgttgtggaggaggcagtcagaccagttccctgtcagggga

SEQ ID NO: 69954 - DNA, 201 bp, Homo sapiens
tgttacacaggctagtcttgaactccttggctcaaagaatccacctgccttggcatcccagagtgctgggattataagcgtgagccactgcaccaggcccktctctcatcttttaaaattcctcagacacctggcccttgaccactattgaattcttcatttgtcagaaataatcaggtgtggcattggccttggtccatc

SEQ ID NO: 69955 - DNA, 201 bp, Homo sapiens
cccagagctgctatagcaacagaagttggaactggacacaagatcatgccacaaaagaccacatttcttagctccccatgcagctctgggtaccttgtgartagattctggtcaacgggaggtgattacaagtgaaaggaatgtgcaaagccttttccttcccatttttctattggctgaaacaaggatactttcttctga

SEQ ID NO: 69956 - DNA, 201 bp, Homo sapiens
tgggactctagatgaagtacagttgcaggctggtgggattaaaggaaccatgaccttgagaggtgtgtgccacagactatccccggttacaccatgatacraggcaacgtccccaactgtagggaggaaaatgatggggtgctcacctgaatccatgcctgaaagggacagggtgcctggtcaaatgccccgtaagcaggt

SEQ ID NO: 69957 - DNA, 201 bp, Homo sapiens
atttttgttgttttttaattgtatttatttaaggtatatgacatgatcttttgatatacaaagtgatatggttactacagtgaagcaaatgaacatatctrtcatcccacatggttatccatctccctccttttttgacaagaacacctaaaacctattcttttggcagaaatctcaaatacaacacattattatttgatg

SEQ ID NO: 69958 - DNA, 201 bp, Homo sapiens
cagagttcagaggtttaaataactttcttaagctggtaggtagttgacctgtgattcaaactctgagtaaggcccatactctcattctcatcctggcctgmccttccagtcatgagcaacaccacaagaccaggctcatctaggagcaggcagaggctcagtcagctcttctacacctgctgcctgtggctgccccagccc

SEQ ID NO: 69959 - DNA, 201 bp, Homo sapiens
atctggattccttgacgtgtctcagactgggtccctgagaagctgtccgctttcagcgcagcatgaggtatttggtagagttgaaaatgccaattgtaacmcagtcaacccactcagcacactgcctgctggtgccgtgccagtgccaaacagacctgtggcttcccaggggacaggtctcaggacactctcagagcttga

SEQ ID NO: 69960 - DNA, 201 bp, Homo sapiens
cagaccaaaggatatttttttcagcttgaatgtccagggtcaatgcttctggctgtctcaaagggaagaagcagttacagcattgttcaaaatggctcttyagagaaatcatttctagctcactccatttgcatctgtatttcagatttgctaggtttcctttgcaaacattttcacttattaccctttatcacctttgct

SEQ ID NO: 69961 - DNA, 201 bp, Homo sapiens
atgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctgggt

SEQ ID NO: 69962 - DNA, 201 bp, Homo sapiens
acaggacctgggaacccacagacagatgcagactgtgacttgggagtgactgctgggcatcccagggttgcacagaccccacatctccgaggctgtgcagrgttcaactccctcgctgatgatctccatctttggttattagttatgaagcattgtctagaaatgtgtcatagtgtgcaattttggttaatctatataaac

SEQ ID NO: 69963 - DNA, 201 bp, Homo sapiens
ttccttgtggttcacacacagagaagcagggtagtagagaggataaaaagggaccctgagctgcctgcctgaactcaaatccagcttccctactagctgtrtggctatggacaagttacacaatctttctgtgaatccatttcccttctgaaaaatgggaatggtcatactaatatctacctcctcgttgctatcatcagg

SEQ ID NO: 69964 - DNA, 201 bp, Homo sapiens
gatgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctggg

SEQ ID NO: 69965 - DNA, 201 bp, Homo sapiens
agatgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctgg

SEQ ID NO: 69966 - DNA, 201 bp, Homo sapiens
aagatgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctg

SEQ ID NO: 69967 - DNA, 201 bp, Homo sapiens
tccattgacctacagcaattatggacctggagtatctaccttccttccacagggcacttattcatagttacctttgaaacctcacaaatccctaaccccaygcgcatttcgttttagcaacatttcacccttttctgagtctctggcttactggctcaggcaactctctcttctccccttcacctcttgcagaaagcaacc

SEQ ID NO: 69968 - DNA, 201 bp, Homo sapiens
aaatatgacctgcaaaactgccacccagagataatcatcaccggtaacatttggggatatgtctttttgagtgtggttttaacacacacacacacactctstctctcacacacacactctcttacacacacacactctcacatacacacacacaaactcacaaactcattttaatttttttgccataaaactaggatgtcc

SEQ ID NO: 69969 - DNA, 201 bp, Homo sapiens
acacttaataaacatcttgtacacatagagatgctgttttctttcctgacacaccagtctataaatcatattcacttttaataccatcctattttcaaaaygcccatataaaataaaataactctacattgaatcaaaatgcccatgttaacacatctgtcccttttttcctctcctcaagtcttcttatttcctaaattc

SEQ ID NO: 69970 - DNA, 201 bp, Homo sapiens
gccctcagctcatggacattctagaagaatgggggacagaaagtagcatggaaaggagggccctggaagtgctagggtgctgaggacagcactgatgacasaaaccctcctgcctctacaccatagaacaccatgtagccacttagagagaagctgaagaatggtagacagtaatctgaaataaagcacatccatggcaca

SEQ ID NO: 69971 - DNA, 201 bp, Homo sapiens
gtatacggggttccaatttctccacaaccttgccaacaccgatcgtctttgttttttcttttctttttttctttttttttgataaaagccatcctgagagrtgtgaggtggtatctcattcctggttttgatttgtatttttctgatgatgagtgacatcttttcagatacccattggtcatatgcatgtcttcttttgac

SEQ ID NO: 69972 - DNA, 201 bp, Homo sapiens
attgctggattgtatggttgtcctatttttaattttttgaggaatctccatactttttccatagaagctataccattttgcatttccatcaacagtatacrgggttccaatttctccacaaccttgccaacaccgatcgtctttgttttttcttttctttttttctttttttttgataaaagccatcctgagagatgtgag

SEQ ID NO: 69973 - DNA, 201 bp, Homo sapiens
gaagagtaggcttatgggttctaaggccatgttctatcctaaggtacccctctttatgacagaacaatacagaaagacacacaaagcacaccagattcacyacagcttaagactaggctcacaaatccttttttctattaaccaaaactttatagaggagataaacaatgatttttgtcgtgcgttcaactggtttgcaca

SEQ ID NO: 69974 - DNA, 201 bp, Homo sapiens
ctcttagcataatgtttttcaggttcatccacattgttgcatgttgcatgatttccttatgtatatatatttgacatatatatgtgtatatatattcattatccatttatctgccaatggacatttaggttgtttccacattttggctgttgtgaatagtgctgcagggaacatgggagtgtggaaatctcttcaggattc

SEQ ID NO: 69975 - DNA, 201 bp, Homo sapiens
tttgaatagaatgggaggcaagtttgccctaagcagttcccagcttgagttttctttagtgattttgggggcccaagatattctcctttaacatttccccscttttttaaaaaaatcttttggagaaagcattttacaagaaaatgaatctctggtctcaggtttcatctgatctctcatggctaggatggtttatttcta

SEQ ID NO: 69976 - DNA, 201 bp, Homo sapiens
tcaatgtgcctttgacattaataattaatttgtagagaaactgaacttattttatctttcaaaatgggcccttacaatcttatgcgcccacctcttccccmatagtccctcagtcttgaggagttgaatagctttcatttcttgccctgtgtctcaggaatgcagcttattttgattagcatcttctatggggcctgaaga

SEQ ID NO: 69977 - DNA, 201 bp, Homo sapiens
agaatgggaggcaagtttgccctaagcagttcccagcttgagttttctttagtgattttgggggcccaagatattctcctttaacatttcccccctttttwaaaaaaatcttttggagaaagcattttacaagaaaatgaatctctggtctcaggtttcatctgatctctcatggctaggatggtttatttctagatgggt

SEQ ID NO: 69978 - DNA, 201 bp, Homo sapiens
aagctttaaattaggcaaaacttgttcactttttttttataaaaaaggacacacttctttttcttctttctttttttttttttaagcagaaatgttttccyacaatatatatttattggaaaacacccaaatactgaaatatctattaatttaatttaactttctattctaaattatgaccagtttgtctacaagtattta

SEQ ID NO: 69979 - DNA, 201 bp, Homo sapiens
taatccaggcacttttggaggccgaggcaggaggattgctgaggccaggagttcaagaccagcctgggcaacatagcaagaccctgtctctacttgaaacrcaaacacacgtacacacacacacacacacacacaaaatacactttggaaaaccacaaggtgatttcacacccgtttcttatagctgaggctgtgagaaaa

SEQ ID NO: 69980 - DNA, 201 bp, Homo sapiens; identical to SEQ ID NO: 48976

SEQ ID NO: 69981 - DNA, 201 bp, Homo sapiens
gcatactactagatatccttcaaaatgttaatagccagataataaccagggtctttcacactagtctcccatgagcttttccaaattatcatttatataartgtataataattcatccaaaggattattaagccctaattaatgtatttttaggacactttattaaagtattgttagtagtaccctagaatacgaattcct

SEQ ID NO: 69982 - DNA, 201 bp, Homo sapiens
actcctcatttccccctttccccagtccatggtagtctctgttctactttctgtctctgtgaatttgcccattttagtacctgacataagtggaatcataytcattcttctgtgtctggcttatggcacttagcacaacgtcttcaaggcttgtctgggttgttgcttgtgtcagagcttcctttctttcttttttttgag

SEQ ID NO: 69983 - DNA, 201 bp, Homo sapiens
gcctgaatgaactagttgcaaaatatacacccctccctgatcctcatctaatgaaagtcacctgttacaagaatggtttaaaaagaacccattgaattccraagaatacctgtcaaaagtgattgatttttagtgaaaatagttttattctgaaaatagttagctttcagaataattttctattaaggccactcagccttg

SEQ ID NO: 69984 - DNA, 201 bp, Homo sapiens
agccttctcctgctatgacgagcccttgggttattttacttctctcttttctcacctactcataaacatcacttttcttagcttggcttttttttttttttaatataatagctttaattcacatacataaaactcactctttcacagtgtacaagtcagtggtttttagtcgattcagtattgtgtaatcttcaccaccat

SEQ ID NO: 69985 - DNA, 201 bp, Homo sapiens
gattgctgaggccaggagttcaagaccagcctgggcaacatagcaagaccctgtctctacttgaaacacaaacacacgtacacacacacacacacacacamaaaatacactttggaaaaccacaaggtgatttcacacccgtttcttatagctgaggctgtgagaaaatctaagtaagatacgttaaaggcagtcactatt

SEQ ID NO: 69986 - DNA, 201 bp, Homo sapiens
ccaagatacggaaacaaccaaagtgttcactgatggatgaatggatcaagaagctgtctgtctgtctgtctgtctgtctgtctatctctatctatctatcyatctatctatctatctatctatctatctatcatctatctgtagtagaatattatttagctttaaaaaagaagattctgccactcaccacaagtgaacctg

SEQ ID NO: 69987 - DNA, 201 bp, Homo sapiens
gtgagatggcttatgcccatatagaatgggacatgatagtctgtgcagcttatgcacacgaacttccaaaatacggtgtaaaggttggcctgacaaatgaygctgcagcatgttgtactggcctgctgctggcatgcaggcttctcagtaggtttggcatggacaagatctataaaggccaagtggaggtaaccagagatg

SEQ ID NO: 69988 - DNA, 201 bp, Homo sapiens
acaatagccaagatacggaaacaaccaaagtgttcactgatggatgaatggatcaagaagctgtctgtctgtctgtctgtctgtctgtctatctctatctrtctatctatctatctatctatctatctatctatctatcatctatctgtagtagaatattatttagctttaaaaaagaagattctgccactcaccacaagt

SEQ ID NO: 69989 - DNA, 201 bp, Homo sapiens
actcacaatagccaagatacggaaacaaccaaagtgttcactgatggatgaatggatcaagaagctgtctgtctgtctgtctgtctgtctgtctatctctrtctatctatctatctatctatctatctatctatctatctatcatctatctgtagtagaatattatttagctttaaaaaagaagattctgccactcaccac

SEQ ID NO: 69990 - DNA, 201 bp, Homo sapiens
attactcacaatagccaagatacggaaacaaccaaagtgttcactgatggatgaatggatcaagaagctgtctgtctgtctgtctgtctgtctgtctatckctatctatctatctatctatctatctatctatctatctatctatcatctatctgtagtagaatattatttagctttaaaaaagaagattctgccactcac

SEQ ID NO: 69991 - DNA, 201 bp, Homo sapiens
agcattactcacaatagccaagatacggaaacaaccaaagtgttcactgatggatgaatggatcaagaagctgtctgtctgtctgtctgtctgtctgtctrtctctatctatctatctatctatctatctatctatctatctatctatcatctatctgtagtagaatattatttagctttaaaaaagaagattctgccact

SEQ ID NO: 69992 - DNA, 201 bp, Homo sapiens
ccatgatacgaggcaacgtccccaactgtagggaggaaaatgatggggtgctcacctgaatccatgcctgaaagggacagggtgcctggtcaaatgccccrtaagcaggtgtgctagtcacgatagggggcaccaatgaacatcttagggaaacttagcactcttcaggatagtgggtaaaactagcagtttctagctgaa

SEQ ID NO: 69993 - DNA, 201 bp, Homo sapiens
tgccaccttcacccttcccttccaactttctccaacccagcctctcattactcatctccaagcttggcttagctgggttaccctacctcccattgtcagaygtgccccttctgcctgatgggcagcaatgtacacgatgctcccaaattagggccacgccttctaaaggaggatatagtcccgccaccagccctttgtgta

SEQ ID NO: 69994 - DNA, 201 bp, Homo sapiens
gagcccagtgagaagcacataggcagtggggctgatgtggaggggctaggctgggggagaggatgcaggcccttctctctccctgcttagatgtttgtccrcattccacaatgtgtaaaaagagtcaagcctggggggcctgatttggggtttgatgggcacttgtagtttctttgtgatacactttgtggctaggtatgg

SEQ ID NO: 69995 - DNA, 201 bp, Homo sapiens
ggaggggctaggctgggggagaggatgcaggcccttctctctccctgcttagatgtttgtccacattccacaatgtgtaaaaagagtcaagcctggggggmctgatttggggtttgatgggcacttgtagtttctttgtgatacactttgtggctaggtatggttgctcactcctgtaatccaggcacttttggaggccga

SEQ ID NO: 69996 - DNA, 201 bp, Homo sapiens
gaaaggcctggaacagacccttcaccagcaccttcagagggagcatggccctgcggacagcttctggcctccagaactgtgagatctatagctctaagctmcagaagctacccagtttgtggtgctttgttacagtggccctaggaaatgaatatacccctctatagaattagcctcttctcttctccggcattggtctga

SEQ ID NO: 69997 - DNA, 201 bp, Homo sapiens
caacaattgtccattgatgaaaaaaaagttttaagggagccatagttaaaagacacaattgacaaggaaattagttacctccatggcacacaattttaatrtaacaattatgattattactgataatgtacactaagttatatcagaattacaggagtttcccataattttggaacacataccaataatatatttatacaa

SEQ ID NO: 69998 - DNA, 201 bp, Homo sapiens
agttttgcaaaggtggtttccattatgtgggacaaattattcattcatgcgctcaataaatagtaagtacttgaggtgtgtcaggaattgggttaggtgakagaggcagattgaactatgtagaagaatttattcctgccccatgtgagctgacattgaactaaaagggagaaatggtttgaatacacaaaccgtgatgat

SEQ ID NO: 69999 - DNA, 201 bp, Homo sapiens
gcttgcataatgacctttgcaaagggtcattgaagaatgaccttttttatcgtcataaaaatgcatacttcttatttagtggattgttcattcatgtcttyatacattttcttttggctgtattaaagttttgttatttatttatagggacacttcttcttatattttgttacttacagggatttttgaggatattagcgc

SEQ ID NO: 70000 - DNA, 201 bp, Homo sapiens
aaacattttcacttattaccctttatcacctttgctaattaaggaagatacagaaaccagatttttagggttttttttttttttttttcaatttcagcctytggccacttcctataaaagatttccctctgctttgaataaaatttctaagcagccttcagagccaaattaaatgatttggaattctctctagctagctga

SEQ ID NO: 70001 - DNA, 201 bp, Homo sapiens
tccgttgctttcatgcttagaaagtccttccatgttccaaggtcaattgcatatttgccatattatcctttttttaatagttccgtttttctttttttttwaaaaaaaccaatccctttgtctatcagcaatttatttggatatgtagtaggaactgagaacacaacttgaattttcccgaatagcaaagttttccaacac

SEQ ID NO: 70002 - DNA, 201 bp, Homo sapiens
ggggtttcaccatgctggtcagactagtctcaaactcctgacctcaagcgacccacccacctcggcttcccaaagtgtcaggattacaggtgtgaactackgcacccggccggagtttgactattttagccacctcatagaagggaaatcatacagtatttgtccttctgtgactgccttatttctcttagcataatgttt

SEQ ID NO: 70003 - DNA, 201 bp, Homo sapiens
gctttctggaaagaaagaggttctgttatacagccagtcttcttgaaaaatgtttgtagaactgctgaaagtatatataatttacgcagaatttatgccaratttgggctgaatatatatgttttggttgtgaccaggacggaggagtgtgttaacagaagcaactttcttaaagcctcccttcccgtgtgattgaagttc

SEQ ID NO: 70004 - DNA, 201 bp, Homo sapiens
ccataggaaggacacaaagacatgaggagtctgggccccttaacccagagttttgttctcgtccctcaatgacctgtatcctgtccccttgtgtcatgtcscctgtgttcttgtcatcatggagacactcctgtctgctcttgcaaacccagggagtataaccaggatttgaggttttccactctaaaccagtcattgagg

SEQ ID NO: 70005 - DNA, 201 bp, Homo sapiens
catagccccagttgttgagggtctctctgcgagtatctttctggtggcacaagcagtgacccctaggcaaattgatgggctcatctggattagtccactgyattttttaggatggccaaagctgctttctggaaagaaagaggttctgttatacagccagtcttcttgaaaaatgtttgtagaactgctgaaagtatatat

SEQ ID NO: 70006 - DNA, 201 bp, Homo sapiens
agcaacacatgatttttgggtaagggctgtccctgctaagtagaatttcattttggattcagagaattcagaaccggagtcagctcagcccaggtggaaakgtaaaaattcacaccaagatcaactcaaactgagtgagaccatggccagcgatggaaagtgaaaaggaaagaaaataactgagcaggcaaagctctgtcc

SEQ ID NO: 70007 - DNA, 201 bp, Homo sapiens
taatctgacacagggctccatatactggttttgcatcaatgtgcctttgacattaataattaatttgtagagaaactgaacttattttatctttcaaaatkggcccttacaatcttatgcgcccacctcttcccccatagtccctcagtcttgaggagttgaatagctttcatttcttgccctgtgtctcaggaatgcagc

SEQ ID NO: 70008 - DNA, 201 bp, Homo sapiens
tgctgagggcaggggccgtgcgtgtgtgctatgttgctgacgtagtccttcctgctgcagtgcctggcacagggcaggcgctcccttgtctctgtaaagaratgaagaggcttggctgagcccaaggactgggaggcaggctgctggcaaggcctggggagacctctccctggctggcccttgtttcttttccttcctctc

SEQ ID NO: 70009 - DNA, 201 bp, Homo sapiens
tgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggt

SEQ ID NO: 70010 - DNA, 201 bp, Homo sapiens
gcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcag

SEQ ID NO: 70011 - DNA, 201 bp, Homo sapiens
cctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctctttttcatgcgtggcattacccctttat

SEQ ID NO: 70012 - DNA, 201 bp, Homo sapiens
cttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatg

SEQ ID NO: 70013 - DNA, 201 bp, Homo sapiens
tgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcctgggagatcagtaggtggtatgggt

SEQ ID NO: 70014 - DNA, 201 bp, Homo sapiens
caccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagt

SEQ ID NO: 70015 - DNA, 201 bp, Homo sapiens
ctgagcgatgctgacactccctgcctgtttttagggccatctctgctgccaacctgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggcc

SEQ ID NO: 70016 - DNA, 201 bp, Homo sapiens
aagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaaggagactggctacacctacatccttcccaagaatgtgcttaagaagttcatctg

SEQ ID NO: 70017 - DNA, 201 bp, Homo sapiens
aagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgt

SEQ ID NO: 70018 - DNA, 201 bp, Homo sapiens; identical to SEQ ID NO: 51328

SEQ ID NO: 70019 - DNA, 201 bp, Homo sapiens
gccctaggcagccaggacactttcgttttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggattt

SEQ ID NO: 70020 - DNA, 201 bp, Homo sapiens
acccgggaggcggagcttgcagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcct

SEQ ID NO: 70021 - DNA, 201 bp, Homo sapiens
tgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccggttgtgttctacacccctaaggagttgggtggactcgg

SEQ ID NO: 70022 - DNA, 201 bp, Homo sapiens
catggctcacattcttaagaattgtagttctttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtt

SEQ ID NO: 70023 - DNA, 201 bp, Homo sapiens
aggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctgggca

SEQ ID NO: 70024 - DNA, 201 bp, Homo sapiens
gaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgaca

SEQ ID NO: 70025 - DNA, 201 bp, Homo sapiens
agccccagatggttctcttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagttt

SEQ ID NO: 70026 - DNA, 201 bp, Homo sapiens
tgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatt

SEQ ID NO: 70027 - DNA, 201 bp, Homo sapiens
gatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttca

SEQ ID NO: 70028 - DNA, 201 bp, Homo sapiens
ttcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcg

SEQ ID NO: 70029 - DNA, 201 bp, Homo sapiens; identical to SEQ ID NO: 51342

SEQ ID NO: 70030 - DNA, 201 bp, Homo sapiens
aagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttt

SEQ ID NO: 70031 - DNA, 201 bp, Homo sapiens
ttcccattcacccttcccattgcttttgtcagtgtgaagtctcggttgaaccagtctcagagggaggagctaggtctgatcgagcaggcctacgataaccyccacgaggcgctgtcccgcatcaagcgtcacctcctcacacagagagccttcaaagaggtgagtgaggcctcccaagttttctttttggttctaccaaag

SEQ ID NO: 70032 - DNA, 201 bp, Homo sapiens
cccttcccattgcttttgtcagtgtgaagtctcggttgaaccagtctcagagggaggagctaggtctgatcgagcaggcctacgataacccccacgaggcrctgtcccgcatcaagcgtcacctcctcacacagagagccttcaaagaggtgagtgaggcctcccaagttttctttttggttctaccaaaggtagcagttg

SEQ ID NO: 70033 - DNA, 201 bp, Homo sapiens
ggataaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaa

SEQ ID NO: 70034 - DNA, 201 bp, Homo sapiens
gcagacacagaaccacctccgctgcttgtttacaagtggtgtcaaggtagaactttcatgagatcgccctgtgaggaacggggcaggaatttagttctacrtcaaaaatctcatctgggtagcatgattggtttactctcttgatgcgtggtagtaaagggaagtagtgttcgtgttaaactgaggaaaagcccatagtca

SEQ ID NO: 70035 - DNA, 201 bp, Homo sapiens
ccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaa

SEQ ID NO: 70036 - DNA, 201 bp, Homo sapiens
ctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttcctt

SEQ ID NO: 70037 - DNA, 201 bp, Homo sapiens
agggatgaagactggaatgaattcaatgatattaacaagattatcatccggcagcctatccgcactgagtacaagattgcttttccttacttgtacaacamtcttccacaccatgtccacctcacctggtaagagacctggaacacaacatttggaaaggagaaggctgctgtttaggttgggccagggcgggaaaacttt

SEQ ID NO: 70038 - DNA, 201 bp, Homo sapiens
aaaaaaaaaaagtctgcttattcttgatgttgtaccctagggatgaagactggaatgaattcaatgatattaacaagattatcatccggcagcctatccgsactgagtacaagattgcttttccttacttgtacaacaatcttccacaccatgtccacctcacctggtaagagacctggaacacaacatttggaaaggaga

SEQ ID NO: 70039 - DNA, 201 bp, Homo sapiens
aatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataataaataaataaataatccgt

SEQ ID NO: 70040 - DNA, 201 bp, Homo sapiens
tgttgaactcaaatctttctttagtagtagggataaaactaactgcatcaagtagtctccaccctccccgcccctggctcatctgtaatttactttttttyctactacctttagattgtgaataagtggaatacagctctcattggccttatgacatactttcgggaggctgtggtgaacacccaagagctcttggactta

SEQ ID NO: 70041 - DNA, 201 bp, Homo sapiens
tctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaat

SEQ ID NO: 70042 - DNA, 201 bp, Homo sapiens
tttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgac

SEQ ID NO: 70043 - DNA, 201 bp, Homo sapiens
tcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcc

SEQ ID NO: 70044 - DNA, 201 bp, Homo sapiens
ttctacgtcaaaaatctcatctgggtagcatgattggtttactctcttgatgcgtggtagtaaagggaagtagtgttcgtgttaaactgaggaaaagcccrtagtcaaagcaatccaaatgaatacgtggaatcatagtgggattggttatggaaggtaatgatagttcctgtggggctagtcttgcaagaggatttctaa

SEQ ID NO: 70045 - DNA, 201 bp, Homo sapiens
gactaatgatgttgaactcaaatctttctttagtagtagggataaaactaactgcatcaagtagtctccaccctccccgcccctggctcatctgtaatttrcttttttttctactacctttagattgtgaataagtggaatacagctctcattggccttatgacatactttcgggaggctgtggtgaacacccaagagctc

SEQ ID NO: 70046 - DNA, 201 bp, Homo sapiens
agtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgc

SEQ ID NO: 70047 - DNA, 201 bp, Homo sapiens
atctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcac

SEQ ID NO: 70048 - DNA, 201 bp, Homo sapiens
ctacgtcaaaaatctcatctgggtagcatgattggtttactctcttgatgcgtggtagtaaagggaagtagtgttcgtgttaaactgaggaaaagcccatrgtcaaagcaatccaaatgaatacgtggaatcatagtgggattggttatggaaggtaatgatagttcctgtggggctagtcttgcaagaggatttctaacc

SEQ ID NO: 70049 - DNA, 201 bp, Homo sapiens
ctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttc

SEQ ID NO: 70050 - DNA, 201 bp, Homo sapiens
tctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacg

SEQ ID NO: 70051 - DNA, 201 bp, Homo sapiens
ctcgggagtggaaaaaagtagaatttgctgaggggagaacaaaagaggttaactctggagaatcctggggcatggctcacattcttaagaattgtagttckttctttctaggacatgaaccatacgaattcatatgggatcatcagaggcctgcagtttgcctcattcatcgtgcagtattatggcctggtgatggatttg

SEQ ID NO: 70052 - DNA, 201 bp, Homo sapiens
gttgcagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtg

SEQ ID NO: 70053 - DNA, 201 bp, Homo sapiens
catgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtg

SEQ ID NO: 70054 - DNA, 201 bp, Homo sapiens
gattgcgccagtgcactctcagcctgggtgactgagcacaactccgcctcgggagtggaaaaaagtagaatttgctgaggggagaacaaaagaggttaacyctggagaatcctggggcatggctcacattcttaagaattgtagttctttctttctaggacatgaaccatacgaattcatatgggatcatcagaggcctgc

SEQ ID NO: 70055 - DNA, 201 bp, Homo sapiens
gtggtggtgggcgcctgtaatcccagctacttgggaggctgaggcaggagaatcacttgaacccgggaagtggaggttgcagtgagctgagattgcgccastgcactctcagcctgggtgactgagcacaactccgcctcgggagtggaaaaaagtagaatttgctgaggggagaacaaaagaggttaactctggagaatc

SEQ ID NO: 70056 - DNA, 201 bp, Homo sapiens
ttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccagtgcactctcagcctgggtgactgagcacaac

SEQ ID NO: 70057 - DNA, 201 bp, Homo sapiens
catctgggtagcatgattggtttactctcttgatgcgtggtagtaaagggaagtagtgttcgtgttaaactgaggaaaagcccatagtcaaagcaatccaratgaatacgtggaatcatagtgggattggttatggaaggtaatgatagttcctgtggggctagtcttgcaagaggatttctaacctgctggagacctgcc

SEQ ID NO: 70058 - DNA, 201 bp, Homo sapiens
cagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtg

SEQ ID NO: 70059 - DNA, 201 bp, Homo sapiens
tcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagcgggtttagggttagga

SEQ ID NO: 70060 - DNA, 201 bp, Homo sapiens
tgaggccatcgccctttgcacttggggcctggctggcttggaggtggcgcaggctgcatgaggcaggagccctgttaacattggctgtttccttctccccraaggtgttcggcatgaccccaacatgaaatatgagctacagctggcgaaccccaaagagttctaccacgaggtgcacaggccctctcacttcctcaactt

SEQ ID NO: 70061 - DNA, 201 bp, Homo sapiens
cttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccgaaggtgttc

SEQ ID NO: 70062 - DNA, 201 bp, Homo sapiens; identical to SEQ ID NO: 51323

SEQ ID NO: 70063 - DNA, 201 bp, Homo sapiens
tcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaa

SEQ ID NO: 70064 - DNA, 201 bp, Homo sapiens
gaggcaggagaatcacttgaacccgggaagtggaggttgcagtgagctgagattgcgccagtgcactctcagcctgggtgactgagcacaactccgcctcrggagtggaaaaaagtagaatttgctgaggggagaacaaaagaggttaactctggagaatcctggggcatggctcacattcttaagaattgtagttctttc

SEQ ID NO: 70065 - DNA, 201 bp, Homo sapiens
acaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagcc

SEQ ID NO: 70066 - DNA, 201 bp, Homo sapiens
ccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctac

SEQ ID NO: 70067 - DNA, 201 bp, Homo sapiens
cttgtttacaagtggtgtcaaggtagaactttcatgagatcgccctgtgaggaacggggcaggaatttagttctacgtcaaaaatctcatctgggtagcaygattggtttactctcttgatgcgtggtagtaaagggaagtagtgttcgtgttaaactgaggaaaagcccatagtcaaagcaatccaaatgaatacgtgga

SEQ ID NO: 70068 - DNA, 201 bp, Homo sapiens
agataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacgtcaaaaatctcatctgggta

SEQ ID NO: 70069 - DNA, 201 bp, Homo sapiens
cattgctaacttgtattcttaacttctgcttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctc

SEQ ID NO: 70070 - DNA, 201 bp, Homo sapiens
cccaccccatccgtctcttctgcagatacattgatcgcatccatatttttttcaggtgagggctttcctggattcctagccttgcagggtactgaggcatrtgctttgcctctgaaatcagctattgtacctgagttgacttaactgctgttggggctttaaaatggaatgaagcggccgggtgcggtagctcacgcctgt

SEQ ID NO: 70071 - DNA, 201 bp, Homo sapiens
ttccagcttgggtgataagagtgagaccctgtctcaaaaaaaaaaaagtctgcttattcttgatgttgtaccctagggatgaagactggaatgaattcaaygatattaacaagattatcatccggcagcctatccgcactgagtacaagattgcttttccttacttgtacaacaatcttccacaccatgtccacctcacct

SEQ ID NO: 70072 - DNA, 201 bp, Homo sapiens
acacccaagagctcttggacttactggtgaagtgtgagaacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaac

SEQ ID NO: 70073 - DNA, 201 bp, Homo sapiens
gtccgtgtgggcgggacagaagcgtttggggcaggtgagcaggtttaaagatgaagaggctgtagaaccatgttgcctcttattcttggggtggacttggyaatatttactggtttattagatgaaaggctgagaacatctcatttgaacttatccccaaaataccttgggaagtattctgtgggaggtccaagagtgtat

SEQ ID NO: 70074 - DNA, 201 bp, Homo sapiens
tagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttagtttttcatcaagtcattttaagcgcg

SEQ ID NO: 70075 - DNA, 201 bp, Homo sapiens
gcagctgttcctcaagataatccacacgtccgtgtgggcgggacagaagcgtttggggcaggtgagcaggtttaaagatgaagaggctgtagaaccatgtkgcctcttattcttggggtggacttggtaatatttactggtttattagatgaaaggctgagaacatctcatttgaacttatccccaaaataccttgggaag

SEQ ID NO: 70076 - DNA, 201 bp, Homo sapiens
ggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagt

SEQ ID NO: 70077 - DNA, 201 bp, Homo sapiens
tctcagtttccaggacatagccactgaggctgcccaccccatccgtctcttctgcagatacattgatcgcatccatatttttttcaggtgagggctttccyggattcctagccttgcagggtactgaggcatgtgctttgcctctgaaatcagctattgtacctgagttgacttaactgctgttggggctttaaaatggaa

SEQ ID NO: 70078 - DNA, 201 bp, Homo sapiens
ggactggttctatgaccaccagccgttgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctg

SEQ ID NO: 70079 - DNA, 201 bp, Homo sapiens
acctcacctggtaagagacctggaacacaacatttggaaaggagaaggctgctgtttaggttgggccagggcgggaaaactttggctgactcttcctttcrttttaggtaccatactcccaatgttgtattcatcaaaactgaggatcctgacttgccagctttctactttgaccctttgatcaacccaatctcccatagg

SEQ ID NO: 70080 - DNA, 201 bp, Homo sapiens
ttacttgtacaacaatcttccacaccatgtccacctcacctggtaagagacctggaacacaacatttggaaaggagaaggctgctgtttaggttgggccarggcgggaaaactttggctgactcttcctttcattttaggtaccatactcccaatgttgtattcatcaaaactgaggatcctgacttgccagctttctact

SEQ ID NO: 70081 - DNA, 201 bp, Homo sapiens
gctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttg

SEQ ID NO: 70082 - DNA, 201 bp, Homo sapiens
ctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctacgcttggagcctgtcaacacccttag

SEQ ID NO: 70083 - DNA, 201 bp, Homo sapiens
tacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggc

SEQ ID NO: 70084 - DNA, 201 bp, Homo sapiens
tgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactcca

SEQ ID NO: 70085 - DNA, 201 bp, Homo sapiens
agtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggag

SEQ ID NO: 70086 - DNA, 201 bp, Homo sapiens
gagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcggga

SEQ ID NO: 70087 - DNA, 201 bp, Homo sapiens
aggcgctctcccgccagtgtctggattctgcctcttgccaaagcagagggggctgccatcccctgcctgccacctgcccctcggctgcatgcccacagccrtacctgcctgaggacaaaggcttgcactgtctcgcccgcgcctggcccccaccccctccccggccagcctgaggctgcctgaggaaggaaggacccgctt

SEQ ID NO: 70088 - DNA, 201 bp, Homo sapiens
atcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagt

SEQ ID NO: 70089 - DNA, 201 bp, Homo sapiens
ttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttttt

SEQ ID NO: 70090 - DNA, 201 bp, Homo sapiens
tcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagc

SEQ ID NO: 70091 - DNA, 201 bp, Homo sapiens
cacctgggcatcgaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctccca

SEQ ID NO: 70092 - DNA, 201 bp, Homo sapiens
tcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccc

SEQ ID NO: 70093 - DNA, 201 bp, Homo sapiens
caccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagct

SEQ ID NO: 70094 - DNA, 201 bp, Homo sapiens
agggccccgtaggggcttctcctacctctgaccctcacactaagtaaaagcccctttcctcggtggtgtgtgtgggaatgctgttggcgaggagagggggwcacggtgtgggctggccacctgggcatcgaagtggtgggagctgggactctggggccagccatcctatggacttgcagagattctcatgcccctggactg

SEQ ID NO: 70095 - DNA, 201 bp, Homo sapiens
accaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctt

SEQ ID NO: 70096 - DNA, 201 bp, Homo sapiens
tcgaactcctgacctcgtgatccgcccacctcgggctcccaaagtgctgggattacaggcatgagccaccgcgcccagccgttctgggctatttctagagrcagaaactaacggcccgtcacttagcctccgtcacaggagttcccaagttatagcgacttcctggagctctgggaaggccattgtgacactctgggtttc

SEQ ID NO: 70097 - DNA, 201 bp, Homo sapiens
ccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctta

SEQ ID NO: 70098 - DNA, 201 bp, Homo sapiens
aatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgc

SEQ ID NO: 70099 - DNA, 201 bp, Homo sapiens
taaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccagg

SEQ ID NO: 70100 - DNA, 201 bp, Homo sapiens
tgaggcaggagaattgtttggactggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagcccggggtcaccaga

SEQ ID NO: 70101 - DNA, 201 bp, Homo sapiens
cttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcacc

SEQ ID NO: 70102 - DNA, 201 bp, Homo sapiens
aggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcg

SEQ ID NO: 70103 - DNA, 201 bp, Homo sapiens
aggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacc

SEQ ID NO: 70104 - DNA, 201 bp, Homo sapiens
ccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtc

SEQ ID NO: 70105 - DNA, 201 bp, Homo sapiens
ggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacct

SEQ ID NO: 70106 - DNA, 201 bp, Homo sapiens
ctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctgggctcaagggatcctccc

SEQ ID NO: 70107 - DNA, 201 bp, Homo sapiens
ccccaggtgcgcgccaccacacccagctaatttttaaattctttgcagagatagggtcttgctgtgttgcccaggttggtgtcgaactcctgggctcaagrgatcctcccctcttggcctcccaaagtgctgggattacaggcgtaaacctccacacccagcctgataaacattcagccctggagtggcggaaaccccaaa

SEQ ID NO: 70108 - DNA, 201 bp, Homo sapiens
gagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagtt

SEQ ID NO: 70109 - DNA, 201 bp, Homo sapiens
gggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagc

SEQ ID NO: 70110 - DNA, 201 bp, Homo sapiens
ggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcg

SEQ ID NO: 70111 - DNA, 201 bp, Homo sapiens
gagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcga

SEQ ID NO: 70112 - DNA, 201 bp, Homo sapiens
agtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgat

SEQ ID NO: 70113 - DNA, 201 bp, Homo sapiens
actcctgacctcatatgatccacccacctcagcctcccaaagtgctgggactacaggtgtgagccaccattctcggcttataatttaattattattattattattattttttttttgagacagagtctcactttgtcaccaggctggagtgcaatgccgtgatctcagctcactgcaacctccacctcttggttcaagcga

SEQ ID NO: 70114 - DNA, 201 bp, Homo sapiens
tcctgacctcatatgatccacccacctcagcctcccaaagtgctgggactacaggtgtgagccaccattctcggcttataatttaattattattattattwttattttttttttgagacagagtctcactttgtcaccaggctggagtgcaatgccgtgatctcagctcactgcaacctccacctcttggttcaagcgatt

SEQ ID NO: 70115 - DNA, 201 bp, Homo sapiens
ccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatctt

SEQ ID NO: 70116 - DNA, 201 bp, Homo sapiens
cctcaagttcctggtcagcggcgaccagaagacaggtaggtgccccgggcagcctcggtcgctgtcactccccggcctgagcccagcccactggccaccgsccggaatgtgttaagctgagccgggccagcggggccatggaaaggccgcatcccaggagctgtctgcccgtcagagctattgcatcactgccagccccaa

SEQ ID NO: 70117 - DNA, 201 bp, Homo sapiens
gtacagattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatccctt

SEQ ID NO: 70118 - DNA, 201 bp, Homo sapiens
gccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctcc

SEQ ID NO: 70119 - DNA, 201 bp, Homo sapiens
catctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctccca

SEQ ID NO: 70120 - DNA, 201 bp, Homo sapiens
aaccaacaccaactcacaaagcagctcctcctttccagaagctgccccactgtggatgggcgagtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggcc

SEQ ID NO: 70121 - DNA, 201 bp, Homo sapiens
atctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctcccag

SEQ ID NO: 70122 - DNA, 201 bp, Homo sapiens
aagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctca

SEQ ID NO: 70123 - DNA, 201 bp, Homo sapiens
gagccaattcctttgctgctggcagagctgacatttgaaaccaacaccaactcacaaagcagctcctcctttccagaagctgccccactgtggatgggcgmgtggcccaggcctgtcggctgtggcggtgtacatgaccgctctgagctccaccctgacgggctcgaggaccccgtctgccatgtgtttggctgaccgtgt

SEQ ID NO: 70124 - DNA, 201 bp, Homo sapiens
actgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccatt

SEQ ID NO: 70125 - DNA, 201 bp, Homo sapiens
ccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttcca

SEQ ID NO: 70126 - DNA, 201 bp, Homo sapiens
ggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaa

SEQ ID NO: 70127 - DNA, 201 bp, Homo sapiens
gacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccaga

SEQ ID NO: 70128 - DNA, 201 bp, Homo sapiens
ggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcct

SEQ ID NO: 70129 - DNA, 201 bp, Homo sapiens
tcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggag

SEQ ID NO: 70130 - DNA, 201 bp, Homo sapiens
gtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctc

SEQ ID NO: 70131 - DNA, 201 bp, Homo sapiens
gatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaa

SEQ ID NO: 70132 - DNA, 201 bp, Homo sapiens
gtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcct

SEQ ID NO: 70133 - DNA, 201 bp, Homo sapiens
ggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgta

SEQ ID NO: 70134 - DNA, 201 bp, Homo sapiens
ggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccacc

SEQ ID NO: 70135 - DNA, 201 bp, Homo sapiens
ttgataacaatctaggagttaaatagatactatcatctgtttacgtcatcatttatgatagatactatcatcatatacacctgaaaaacgaggcctggagygatggaggagcttgttcaaggtcagagccagcactcacatatgggtcttaagacactggagcagccaagggcctctagaccaggacattccactcggagc

SEQ ID NO: 70136 - DNA, 201 bp, Homo sapiens
agtgccagccggatgctgcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcctgggggagggaaagggatttgcctgatttcacccaagaggtgacccc

SEQ ID NO: 70137 - DNA, 201 bp, Homo sapiens
cctgacctcatatgatccacccacctcagcctcccaaagtgctgggactacaggtgtgagccaccattctcggcttataatttaattattattattattattattttttttttgagacagagtctcactttgtcaccaggctggagtgcaatgccgtgatctcagctcactgcaacctccacctcttggttcaagcgattc

SEQ ID NO: 70138 - DNA, 201 bp, Homo sapiens
tgacctcatatgatccacccacctcagcctcccaaagtgctgggactacaggtgtgagccaccattctcggcttataatttaattattattattattattwttttttttttgagacagagtctcactttgtcaccaggctggagtgcaatgccgtgatctcagctcactgcaacctccacctcttggttcaagcgattctc

SEQ ID NO: 70139 - DNA, 201 bp, Homo sapiens
cttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactcca

SEQ ID NO: 70140 - DNA, 201 bp, Homo sapiens
caggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgc

SEQ ID NO: 70141 - DNA, 201 bp, Homo sapiens
tgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaa

SEQ ID NO: 70142 - DNA, 201 bp, Homo sapiens
cttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggc

SEQ ID NO: 70143 - DNA, 201 bp, Homo sapiens
ggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaa

SEQ ID NO: 70144 - DNA, 201 bp, Homo sapiens
agagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcc

SEQ ID NO: 70145 - DNA, 201 bp, Homo sapiens
tctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacctgcagccccccaagccctcagttattccacggcccctgtgcagtcactg

SEQ ID NO: 70146 - DNA, 201 bp, Homo sapiens
gcagtctcggctcactgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctca

SEQ ID NO: 70147 - DNA, 201 bp, Homo sapiens
tctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccggctaattttttgt

SEQ ID NO: 70148 - DNA, 201 bp, Homo sapiens
ttacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcagatgatgactttcattcattccactcaaccgagc

SEQ ID NO: 70149 - DNA, 201 bp, Homo sapiens
agctcgaggccgtggtcagcaacctcttgctcagtgctgtgcccatacacgtctgtcagcagggccctggttctagtgtttgccgacttccacggtgcacrtgcactcaccgtggctgatttccagctgcccatgtgttgccactgactgtggaactggagagtcacagtgacacgtggtatttctacagtagatgtgaaa

SEQ ID NO: 70150 - DNA, 201 bp, Homo sapiens
gtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcag

SEQ ID NO: 70151 - DNA, 201 bp, Homo sapiens
cagtgctgtgcccatacacgtctgtcagcagggccctggttctagtgtttgccgacttccacggtgcacatgcactcaccgtggctgatttccagctgccyatgtgttgccactgactgtggaactggagagtcacagtgacacgtggtatttctacagtagatgtgaaaagcctggccgggcacggcggctcacgcctgt

SEQ ID NO: 70152 - DNA, 201 bp, Homo sapiens
tgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatgggg

SEQ ID NO: 70153 - DNA, 201 bp, Homo sapiens
agaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccac

SEQ ID NO: 70154 - DNA, 201 bp, Homo sapiens
ctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagc

SEQ ID NO: 70155 - DNA, 201 bp, Homo sapiens
tacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctt

SEQ ID NO: 70156 - DNA, 201 bp, Homo sapiens
tccctggggtaactggaggtccctggtgcctttactcaggcagtgctgcctcacccactccattccttgtccccgtggctcctgcttgcagcagtagaacstgcagccccccaagccctcagttattccacggcccctgtgcagtcactggccccacaagtcacccatcctgggccctggcgtgctctctccatccatcct

SEQ ID NO: 70157 - DNA, 201 bp, Homo sapiens
ggagattaatgcctgtccccgaaaggcacaggttggagtgtttacttcttcctctcctttcctctctccccccttagagatcgtgacccttcctgcttgcytccctggtgggctctttcaggctggacacagggtttaaaaaaaaaaaaaaaaaagcagaaaaaaagtcatcgtccccagagaaagcttttagtgtctcac

SEQ ID NO: 70158 - DNA, 201 bp, Homo sapiens
tcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgctat

SEQ ID NO: 70159 - DNA, 201 bp, Homo sapiens
agctttctgctttggccaagagttgttaggagattaatgcctgtccccgaaaggcacaggttggagtgtttacttcttcctctcctttcctctctcccccsttagagatcgtgacccttcctgcttgcctccctggtgggctctttcaggctggacacagggtttaaaaaaaaaaaaaaaaaagcagaaaaaaagtcatcg

SEQ ID NO: 70160 - DNA, 201 bp, Homo sapiens
acaagctttctgctttggccaagagttgttaggagattaatgcctgtccccgaaaggcacaggttggagtgtttacttcttcctctcctttcctctctccycccttagagatcgtgacccttcctgcttgcctccctggtgggctctttcaggctggacacagggtttaaaaaaaaaaaaaaaaaagcagaaaaaaagtca

SEQ ID NO: 70161 - DNA, 201 bp, Homo sapiens
gtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcc

SEQ ID NO: 70162 - DNA, 201 bp, Homo sapiens
accccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaa

SEQ ID NO: 70163 - DNA, 201 bp, Homo sapiens
agactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcct

SEQ ID NO: 70164 - DNA, 201 bp, Homo sapiens
tttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctac

SEQ ID NO: 70165 - DNA, 201 bp, Homo sapiens
tcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaagg

SEQ ID NO: 70166 - DNA, 201 bp, Homo sapiens
cctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtc

SEQ ID NO: 70167 - DNA, 201 bp, Homo sapiens
taactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcac

SEQ ID NO: 70168 - DNA, 201 bp, Homo sapiens
ccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccagg

SEQ ID NO: 70169 - DNA, 201 bp, Homo sapiens
agtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctc

SEQ ID NO: 70170 - DNA, 201 bp, Homo sapiens
ccaaagcagagggggctgccatcccctgcctgccacctgcccctcggctgcatgcccacagccgtacctgcctgaggacaaaggcttgcactgtctcgccygcgcctggcccccaccccctccccggccagcctgaggctgcctgaggaaggaaggacccgcttcctgttgtcggtgctaattcctttgtaattccagccc

SEQ ID NO: 70171 - DNA, 201 bp, Homo sapiens
gtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccg

SEQ ID NO: 70172 - DNA, 201 bp, Homo sapiens
ataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctc

SEQ ID NO: 70173 - DNA, 201 bp, Homo sapiens
gtgtttacttcttcctctcctttcctctctccccccttagagatcgtgacccttcctgcttgcctccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttg

SEQ ID NO: 70174 - DNA, 201 bp, Homo sapiens
acaggtaggtgccccgggcagcctcggtcgctgtcactccccggcctgagcccagcccactggccaccggccggaatgtgttaagctgagccgggccagcsgggccatggaaaggccgcatcccaggagctgtctgcccgtcagagctattgcatcactgccagccccaactgtttcttcgtgtccccatcagggtttcct

SEQ ID NO: 70175 - DNA, 201 bp, Homo sapiens
ggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactg

SEQ ID NO: 70176 - DNA, 201 bp, Homo sapiens
tcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctccc

SEQ ID NO: 70177 - DNA, 201 bp, Homo sapiens
attggctccggaggatggggttgatccaactccaggctgacactgcccctggggtgagggcccccaggaattggagggcgggggctgaggggacggtcccytaaggccttatgcccacagtcgccttttcctcccccagatcctctccttcatcctgcacacaatcgtgcgaggattcatccactccgctgtcgggggcct

SEQ ID NO: 70178 - DNA, 201 bp, Homo sapiens
gggacttgggccaaatggccatccaagcctgctgcggggtagcctgagccctcgagaggccgccagccagccctggcattcccagtggggggactctgaaygggcacctgcccttctgatctttgggaatccctgtcatgaccctgaggtcagggtttccttccctcttcacacagagaatgtcaccaatggcacagtggg

SEQ ID NO: 70179 - DNA, 201 bp, Homo sapiens
tccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgcctgg

SEQ ID NO: 70180 - DNA, 201 bp, Homo sapiens
agggctgtgcctctttgcgcggctcagcacagggacagcaggggtggccagacgcccctgcctgctgcggctctggcctccccgggctaactctgcccccycccccccccaccccgtccccgcggtgcctgtcagctcatctatgatgctggtgtctccttcatcgtcgtcctcgtggtctgggccggctgctccgggctg

SEQ ID NO: 70181 - DNA, 201 bp, Homo sapiens
caagttcctggtcagcggcgaccagaagacaggtaggtgccccgggcagcctcggtcgctgtcactccccggcctgagcccagcccactggccaccggccrgaatgtgttaagctgagccgggccagcggggccatggaaaggccgcatcccaggagctgtctgcccgtcagagctattgcatcactgccagccccaactg

SEQ ID NO: 70182 - DNA, 201 bp, Homo sapiens
tgtgcctctttgcgcggctcagcacagggacagcaggggtggccagacgcccctgcctgctgcggctctggcctccccgggctaactctgccccctccccyccccaccccgtccccgcggtgcctgtcagctcatctatgatgctggtgtctccttcatcgtcgtcctcgtggtctgggccggctgctccgggctggtttt

SEQ ID NO: 70183 - DNA, 201 bp, Homo sapiens
ccctgggtatcgtcatggacaagtatggcccgaggaagctcaggctgctgggcaggtcagtgtgggtcccttagggggcagggagtgggcaggtggacccyctgggctgagttccccacagaagggtatcctggtcgtacctgatatcaggtgtactgtggagctccctgaaggccctccagaatggagttcctaccccgt

SEQ ID NO: 70184 - DNA, 201 bp, Homo sapiens
tcgctgtcactccccggcctgagcccagcccactggccaccggccggaatgtgttaagctgagccgggccagcggggccatggaaaggccgcatcccaggmgctgtctgcccgtcagagctattgcatcactgccagccccaactgtttcttcgtgtccccatcagggtttcctggtccaggagggagggaaggaccaaaa

SEQ ID NO: 70185 - DNA, 201 bp, Homo sapiens
tccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcac

SEQ ID NO: 70186 - DNA, 201 bp, Homo sapiens
ggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcgtcaggggcaggttctttgacctttccctc

SEQ ID NO: 70187 - DNA, 201 bp, Homo sapiens
tccgcccacctcgggctcccaaagtgctgggattacaggcatgagccaccgcgcccagccgttctgggctatttctagaggcagaaactaacggcccgtcrcttagcctccgtcacaggagttcccaagttatagcgacttcctggagctctgggaaggccattgtgacactctgggtttcattagctgtttcttagaaac

SEQ ID NO: 70188 - DNA, 201 bp, Homo sapiens
actccaggggacttgggccaaatggccatccaagcctgctgcggggtagcctgagccctcgagaggccgccagccagccctggcattcccagtggggggaytctgaatgggcacctgcccttctgatctttgggaatccctgtcatgaccctgaggtcagggtttccttccctcttcacacagagaatgtcaccaatggca

SEQ ID NO: 70189 - DNA, 201 bp, Homo sapiens
gagcacctggggtccgttcttggatcatccagggtgtctgcgtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggccaacacg

SEQ ID NO: 70190 - DNA, 201 bp, Homo sapiens
gggtgcctggccgggcgcggtggctcacacctgtaatcccagcactttgggaggccaaggcgggtggatcacaaggtcagaagatcgagaccatcctggcyaacacggtgaaaccctgtctctacaaaaacgcaaaaattagccgggtaaggtggcgcgtgcctgtagtcccagctactcgggaggctgaggcaggagaat

SEQ ID NO: 70191 - DNA, 201 bp, Homo sapiens
cctggccgggcgcggtggctcacacctgtaatcccagcactttgggaggccaaggcgggtggatcacaaggtcagaagatcgagaccatcctggccaacayggtgaaaccctgtctctacaaaaacgcaaaaattagccgggtaaggtggcgcgtgcctgtagtcccagctactcgggaggctgaggcaggagaatcgctt

SEQ ID NO: 70192 - DNA, 201 bp, Homo sapiens
gtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagt

SEQ ID NO: 70193 - DNA, 201 bp, Homo sapiens
gaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggcttt

SEQ ID NO: 70194 - DNA, 201 bp, Homo sapiens
aacgactggcttgcaaaatttctgaaaattcacaattggctccggaggatggggttgatccaactccaggctgacactgcccctggggtgagggcccccargaattggagggcgggggctgaggggacggtcccttaaggccttatgcccacagtcgccttttcctcccccagatcctctccttcatcctgcacacaatcg

SEQ ID NO: 70195 - DNA, 201 bp, Homo sapiens
ggaagtcacacagggtcaggacgaagcaaacacctcacagtccatcagcccaagttccccagaccctgtgggtctgccagggccccgtaggggcttctccyacctctgaccctcacactaagtaaaagcccctttcctcggtggtgtgtgtgggaatgctgttggcgaggagagggggtcacggtgtgggctggccacctg

SEQ ID NO: 70196 - DNA, 201 bp, Homo sapiens
gctcagtggggacagtcatctttttgttttatgtaggtctcactgaaagaaaagttgtaaaaaggcaacaaggcatttgaggtggggaggcctgcacagcktgtgtgtgtgtgtgtgtgtgtgtgtgtgtgtgtgtgggcactgggcacagccctctttcaacactgccaagagcagcccctgcccccccaccacccacat

SEQ ID NO: 70197 - DNA, 201 bp, Homo sapiens
tcagtggggacagtcatctttttgttttatgtaggtctcactgaaagaaaagttgtaaaaaggcaacaaggcatttgaggtggggaggcctgcacagcgtstgtgtgtgtgtgtgtgtgtgtgtgtgtgtgtgtgggcactgggcacagccctctttcaacactgccaagagcagcccctgcccccccaccacccacattc

SEQ ID NO: 70198 - DNA, 201 bp, Homo sapiens
tgataacaatctaggagttaaatagatactatcatctgtttacgtcatcatttatgatagatactatcatcatatacacctgaaaaacgaggcctggagckatggaggagcttgttcaaggtcagagccagcactcacatatgggtcttaagacactggagcagccaagggcctctagaccaggacattccactcggagca

SEQ ID NO: 70199 - DNA, 201 bp, Homo sapiens
cagtggggacagtcatctttttgttttatgtaggtctcactgaaagaaaagttgtaaaaaggcaacaaggcatttgaggtggggaggcctgcacagcgtgygtgtgtgtgtgtgtgtgtgtgtgtgtgtgtgtgggcactgggcacagccctctttcaacactgccaagagcagcccctgcccccccaccacccacattcc

SEQ ID NO: 70200 - DNA, 201 bp, Homo sapiens
ctgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactga

SEQ ID NO: 70201 - DNA, 201 bp, Homo sapiens; identical to SEQ ID NO: 51319

SEQ ID NO: 70202 - DNA, 201 bp, Homo sapiens
gggaagttgaggctgcagtgaactgagattgcaccagtgcactccagcccgggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacac

SEQ ID NO: 70203 - DNA, 201 bp, Homo sapiens
tgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaa

SEQ ID NO: 70204 - DNA, 201 bp, Homo sapiens
atttccagctgcccatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaa

SEQ ID NO: 70205 - DNA, 201 bp, Homo sapiens
tgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacat

SEQ ID NO: 70206 - DNA, 201 bp, Homo sapiens
ccctgggccaaaaggcacgtacgtccggcatcttagagaagctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccaggggg

SEQ ID NO: 70207 - DNA, 201 bp, Homo sapiens
ccggccgggaaggcacaggaggtggccgggggaggggagcacacccttcccctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcag

SEQ ID NO: 70208 - DNA, 201 bp, Homo sapiens
ggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctct

SEQ ID NO: 70209 - DNA, 201 bp, Homo sapiens
cctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatg

SEQ ID NO: 70210 - DNA, 201 bp, Homo sapiens
tgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctc

SEQ ID NO: 70211 - DNA, 201 bp, Homo sapiens
tgatcttgtggttgaagaaaccagctctggggaagggtctcgggcgcgggcgggagggcacctgtcagggtccctgggagaggcagccctcggatctgccsctgcccacctcacgctgcgttccatgctggccccaggcgatgtcagtcctgctgcaggccaggactagttccacggccctgagcatgcgttagccccttc

SEQ ID NO: 70212 - DNA, 201 bp, Homo sapiens
cccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcc

SEQ ID NO: 70213 - DNA, 201 bp, Homo sapiens
agtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctagggtatcagaa

SEQ ID NO: 70214 - DNA, 201 bp, Homo sapiens
aggagattaatgcctgtccccgaaaggcacaggttggagtgtttacttcttcctctcctttcctctctccccccttagagatcgtgacccttcctgcttgyctccctggtgggctctttcaggctggacacagggtttaaaaaaaaaaaaaaaaaagcagaaaaaaagtcatcgtccccagagaaagcttttagtgtctca

SEQ ID NO: 70215 - DNA, 201 bp, Homo sapiens
agaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggaggggagggtacagcctggagg

SEQ ID NO: 70216 - DNA, 201 bp, Homo sapiens
gtgattcaggagaggagggtacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagc

SEQ ID NO: 70217 - DNA, 201 bp, Homo sapiens
aggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattc

SEQ ID NO: 70218 - DNA, 201 bp, Homo sapiens
tctttgggaggatgtagtttgccctaggcctggatttcggtagaatgagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccga

SEQ ID NO: 70219 - DNA, 201 bp, Homo sapiens
tcacccactccattccttgtccccgtggctcctgcttgcagcagtagaacctgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaa

SEQ ID NO: 70220 - DNA, 201 bp, Homo sapiens
cggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacc

SEQ ID NO: 70221 - DNA, 201 bp, Homo sapiens
taaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggactctgaatgg

SEQ ID NO: 70222 - DNA, 201 bp, Homo sapiens
aagctcaggctgctgggcaggtcagtgtgggtcccttagggggcagggagtgggcaggtggaccccctgggctgagttccccacagaagggtatcctggtygtacctgatatcaggtgtactgtggagctccctgaaggccctccagaatggagttcctaccccgtccgccaccgaatcagcaggtactgtggtcctcgcc

SEQ ID NO: 70223 - DNA, 201 bp, Homo sapiens
aggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataa

SEQ ID NO: 70224 - DNA, 201 bp, Homo sapiens
gtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccgggcagcatgtgcttggaggtgcccggttgttgtgggtaggaaacagcccag

SEQ ID NO: 70225 - DNA, 201 bp, Homo sapiens
agagtttgtatgttggggaaaggggaaaggcaagagtgtggggagggaggaagggccctggctggtccttctcaggatcccctttcccgcttctctgcccrtcaccctgctgtgcttggctctaagcacaccgtcccctcctgcttctctggccctggcccccatcaccttcacactccctcaggctgccctttcttcccc

SEQ ID NO: 70226 - DNA, 201 bp, Homo sapiens; identical to SEQ ID NO: 51350

SEQ ID NO: 70227 - DNA, 201 bp, Homo sapiens; identical to SEQ ID NO: 51338

SEQ ID NO: 70228 - DNA, 201 bp, Homo sapiens; identical to SEQ ID NO: 51351

SEQ ID NO: 70229 - DNA, 201 bp, Homo sapiens; identical to SEQ ID NO: 51329

SEQ ID NO: 70230 - DNA, 201 bp, Homo sapiens
ctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttga

SEQ ID NO: 70231 - DNA, 201 bp, Homo sapiens; identical to SEQ ID NO: 51331

SEQ ID NO: 70232 - DNA, 201 bp, Homo sapiens
gctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgcagacg

SEQ ID NO: 70233 - DNA, 201 bp, Homo sapiens; identical to SEQ ID NO: 51332

SEQ ID NO: 70234 - DNA, 201 bp, Homo sapiens
cacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggcc

SEQ ID NO: 70235 - DNA, 201 bp, Homo sapiens
tgtaccgagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccagga

SEQ ID NO: 70236 - DNA, 201 bp, Homo sapiens
tgaggcaggagaatggcttgaacccagaaggtggagcttgcagtgagctgagatcatgccactgcactccagcctgggcgacagagcgagactccatctcaaaaaaaaaaaaaaaaatttaaaaattagcagggtgccgtagtgtgcacctgcagttccacctacttgagaggctgaagtgggaggattactgctgccttg

SEQ ID NO: 70237 - DNA, 201 bp, Homo sapiens
ggaatttacaggcgcgtgccaccacgccagctaattttgtatttttagtagaggcggggtttcaccatgttcgccaggttggtctgggactcctggcctcragtgatctgctcgcctcccaaagtgctgggattataggcgtgagccacactttgccttctttgcaccagggagaattatattttttctcattttttattt

SEQ ID NO: 70238 - DNA, 201 bp, Homo sapiens
cctggcctcaggtgatccgcctgcctcgacctcccaaagtgctgggactacaggcatgagttgccgcgtgcagccctgcagtcctgttttttttttttttkgggcggagtttcactcttgttacccaggctggagtgcaatggcgcgatctcagctcaccgcaacctctgcctcctgggttcaagcagttctcctgccttg

SEQ ID NO: 70239 - DNA, 201 bp, Homo sapiens
ggagcagaaagcaaattgggactcttcgaagggggcctgatgttgtggggaaactgcgtgcaaatccagctctctgctctgacccctcccaggggaatttrcctgtgtggacactcagccggggcccacctggctgccatgatgctcctggccgactggaccaagcatggggtcacgcccaacctcagaggtttccatggg

SEQ ID NO: 70240 - DNA, 201 bp, Homo sapiens
ggagagtctcactctgttgcccaggctggagggcagtggtgctatgtcatctcactgcaacctccacctcctgggttcaagcagttcttgtgcctcagctkcccgaatagctgggattgcagatgtgcaccaccacgcccggctaatttttgtgtttttagtagagacagggtttcgccatgttggccaggctggtctcaa

SEQ ID NO: 70241 - DNA, 201 bp, Homo sapiens
gctgggattgcaggttcccggttggtatttccttatttggaaagaccatctttgtaggtgttattagctaaagtcaagtcattctgggttagggtgggccmtaaatgccattgactgctatcctgctaagagacagaagagggagggacacacagggaggggaccacgtgaagacggaggcagagacgggaagaggcagag

SEQ ID NO: 70242 - DNA, 201 bp, Homo sapiens
aattgccttgcacagtggctcacacctataatcccacacattgggaggctgaggcaggaggattgagttagaaaccagcctggtcaacatagcaagacccycatctctacaaaagaaaagataaatttgctgggcatagtggtgcacacctatactcctgcttgggaggctgaggcaggaggatcgcttgagcccaggagg

SEQ ID NO: 70243 - DNA, 201 bp, Homo sapiens
cattgcactccagcctgggcgacagagcgaggccctatcgcttagaaaacaaaaagttacatgaagttcccccaaggtcccgtagctagcatgtgatgtgkcagggagagagcctgtccgcttcactctctcacatgggaccagaaaggggtgatgctgtgcgtggacaggacatctggcaagtggtgtgtccaggacaca

SEQ ID NO: 70244 - DNA, 201 bp, Homo sapiens
tgagatcatgccactgcactccagcctgggcgatagagcgagactcagtttcaaataaataaataaacatcaaaataaaaagttactgtattaaagaatgrgggcggggtgggaggggtggggagaggttgcaaaaataaataaataaataaataaaccccaaaatgaaaaagacagtggaggcaccaggcctgcgtgggg

SEQ ID NO: 70245 - DNA, 201 bp, Homo sapiens
agatcttggctcactgcaagctccgcctcccaggttcacgccattctcctgcctcagccacccaagtagctggtactacaggcgcccaccaccatgcccasctaattttttgaatagagacggggtttcaccgtgttagccaggatggtagcattagaaattatttctaacccaggctgggctccatggctcatccctgta

SEQ ID NO: 70246 - DNA, 201 bp, Homo sapiens; identical to SEQ ID NO: 49878

SEQ ID NO: 70247 - DNA, 201 bp, Homo sapiens; identical to SEQ ID NO: 49880

SEQ ID NO: 70248 - DNA, 201 bp, Homo sapiens
tagcttctcgtcagtacgtcagtacgcagggagccctgcaggggcaagtggttggtaacgtgggtgctggcaaaacaggttttgcaacctcactggcgttstgcaaaggcagcttcctgcctggattggcccatgggcaacttccctttgatttccctcagctttaatccatccagctgaagtggagacagcccggtttat

SEQ ID NO: 70249 - DNA, 201 bp, Homo sapiens
tattattattattatttttgtttttgagacggagtcttgctctgtcacccaggctggagtgcagtggcaagatcttggctcactgcaagctccgcctcccrggttcacgccattctcctgcctcagccacccaagtagctggtactacaggcgcccaccaccatgcccagctaattttttgaatagagacggggtttcacc

SEQ ID NO: 70250 - DNA, 201 bp, Homo sapiens; identical to SEQ ID NO: 49884

SEQ ID NO: 70251 - DNA, 201 bp, Homo sapiens
gacatttacttccccgacgagtcgtctgaaggttgtcggtgaaggggctgggggtcccggggcttgggggtccagtggcagagctcagcagggcgggcctygctcacacgccctgtgcttggttttgcagccttgcctttcttcctgttctttcacggaggatactggcagagcggaaggtgagtcgggggatgtggatgg

SEQ ID NO: 70252 - DNA, 201 bp, Homo sapiens
tacgataaagtttaatttataaattggcaaagggtatataaatattccttctaagagattaacaataactaataaagtagaacgattaaaacaatatactrtgatcaaagttatgtgaagccaggtgctgtggctcatgcctgtaatcccagcactttgggaggctgagacaggtggatcacctgaggtcaggagttggag

SEQ ID NO: 70253 - DNA, 201 bp, Homo sapiens
ataaatattccttctaagagattaacaataactaataaagtagaacgattaaaacaatatactgtgatcaaagttatgtgaagccaggtgctgtggctcaygcctgtaatcccagcactttgggaggctgagacaggtggatcacctgaggtcaggagttggagaccagcctggccaacatgacaaaaccccgtctctact

SEQ ID NO: 70254 - DNA, 201 bp, Homo sapiens; identical to SEQ ID NO: 49896

SEQ ID NO: 70255 - DNA, 201 bp, Homo sapiens
agccccaccccaggcagcttgaaatcagagctggggtccaaagggaccacaccccgagggactgtgtgggggtcggggcacacaggccactgcttcccccygtctttctcagccattcctgaagtcagcctcactctgcttctcagggatttcaaatgtgcagagactctggcacttttgtagaagccccttctggtccta

SEQ ID NO: 70256 - DNA, 201 bp, Homo sapiens
tatgcgtctagacatgcggatatattcaagctgggcacagcacagcagccccaccccaggcagcttgaaatcagagctggggtccaaagggaccacacccygagggactgtgtgggggtcggggcacacaggccactgcttccccccgtctttctcagccattcctgaagtcagcctcactctgcttctcagggatttcaa

SEQ ID NO: 70257 - DNA, 201 bp, Homo sapiens
tgaccttgtggtccacccgcctcggcctcccaaagtgctgggattgcaggtgtgcgccgccgcgcccggccaggcttttttttctctaggcctgctgtggycaccaaggctggggaccagggggcctccagggacagggatcccaagttgcacgttaatacacggagccctttctgagatgcaggttctacagggaactgg

SEQ ID NO: 70258 - DNA, 201 bp, Homo sapiens
tggcccccttcccagagacaggggaggatcctccacccactccccagcctccaggaccatcctgactcctgccttcaggcactcaagttatgcgtctagayatgcggatatattcaagctgggcacagcacagcagccccaccccaggcagcttgaaatcagagctggggtccaaagggaccacaccccgagggactgtgt

SEQ ID NO: 70259 - DNA, 201 bp, Homo sapiens
agcaaagaatagccccctcctttcctggtgcaccttcagatgtgccgatggggcccaggctcgctgcagatggcccccttcccagagacaggggaggatcstccacccactccccagcctccaggaccatcctgactcctgccttcaggcactcaagttatgcgtctagacatgcggatatattcaagctgggcacagcac

SEQ ID NO: 70260 - DNA, 201 bp, Homo sapiens
tggggtttcaccatattggccagggtggtctcgaatgcctgaccttgtggtccacccgcctcggcctcccaaagtgctgggattgcaggtgtgcgccgccscgcccggccaggcttttttttctctaggcctgctgtggccaccaaggctggggaccagggggcctccagggacagggatcccaagttgcacgttaataca

SEQ ID NO: 70261 - DNA, 201 bp, Homo sapiens
atctctactaaaaatacaaaaattagcctggtgtggtggtgcatgcctttaatctcagctactcgggaggctgaggcaggagaatcgcttgaacccgtggyggggaggaggttgcagtgagctgagatcatgccactgcactccagcctgggcgatagagcgagactcagtttcaaataaataaataaacatcaaaataaa

SEQ ID NO: 70262 - DNA, 201 bp, Homo sapiens
atttttagtagaaatggggtttcatcatgttggtcaggctgatcttgaactcctgacctcgtgatcccgcctccgcctcccaaagtgctgggattacaggygtgagccaccgcgcccagcctctgtttttttttttctttttttaattctccaaactgcctcagaatggttccttgttactttctgcataaagtgtgaagg

SEQ ID NO: 70263 - DNA, 201 bp, Homo sapiens
gctggagtgcaatggcgcgatctcagctcaccgcaacctctgcctcctgggttcaagcagttctcctgccttggcctcccaagtagctgggattacaggcrtgcgccaccacgtccagctaattttgtatttttagtagagatggggtttctccatgttggtcaggctggtctggaactcccgacctcaggtcatctgccc

SEQ ID NO: 70264 - DNA, 201 bp, Homo sapiens
cagggtggtctcgaatgcctgaccttgtggtccacccgcctcggcctcccaaagtgctgggattgcaggtgtgcgccgccgcgcccggccaggcttttttytctctaggcctgctgtggccaccaaggctggggaccagggggcctccagggacagggatcccaagttgcacgttaatacacggagccctttctgagatgc

SEQ ID NO: 70265 - DNA, 201 bp, Homo sapiens
aggctggagtgcagtggcgcgatctgggctcactgcaacctcttcttccagggttcacgccattctccggcctcagcctcctgagtagctgggactacatgcgcccgcaaccatgcccggctaatttttttgtatttttagtagagatggggtttcactgtgttagccaggatggtctccaactcctgacctcatgatccg

SEQ ID NO: 70266 - DNA, 201 bp, Homo sapiens
ccaaagtgctgggattacaggtatgagccaccgtgcctggactttcaccttttctttctttaaagaaatctggacttgggaacctgtaaactagtgaagtmttaaggtccatttccatctctaccctgtatctgcaaagtgctgtaccacgatctgaacacctggtaatgcatccgtgctgggatggggagcaggccccga

SEQ ID NO: 70267 - DNA, 201 bp, Homo sapiens
aatggtgggatctcagctcgctgcaacctccacctcccgagttccagcgattctcctgcctcagcctcccgagtagctgagattacgggcgcccgccaccatgcccagctaatttttgtatttttagtagagacggagtttcaccatgttggccaggatggtctcgaactcctgacctcaggtgattcacccgcctcagcc

SEQ ID NO: 70268 - DNA, 201 bp, Homo sapiens
aaaaaatttaaaggccaggcgtggcagctcacgcatgtaatcccagcactttgcggggctgaggtgggcagatcacaaggtcaggagattgagaccatccyggctaacacggtgaaaccctgtctctactaaaaatacaaaaaattagctgggcgtggtgcgggcacctgtagtcccatctactctggagactgaggcagg

SEQ ID NO: 70269 - DNA, 201 bp, Homo sapiens
tattgaaacttcaagtcatatgaatgaaagaaaattaaaaggaaaggattaaaaaggaaaaaaaaaaaagaggccaggaactgtcacacacgcctgtaatsccagtactgtgggaggtcaaagcacgaggatcctttgaggccaggagtttgagaccagcctgggcaacatagcaataacctgcctctacaaaaaatttaa

SEQ ID NO: 70270 - DNA, 201 bp, Homo sapiens
gtggctcacatctgtaatcccagcactttgggaggccgaggcaggcagatcacttgaggtcaggagtttgagaccagcctggcaaacatggtgaaaccccrtctctactaaaaatacaaaaattagcctggtgtggtggtgcatgcctttaatctcagctactcgggaggctgaggcaggagaatcgcttgaacccgtggc

SEQ ID NO: 70271 - DNA, 201 bp, Homo sapiens
gggtttcccaagcaaggttccttggaagaagatgtctgcagaggtaggtggattgcagggagggactaaggggctggggcggagttagctcatttattagwttggaattccaagaaggaagcttagaagccgtctagagcactcctgtgggcatgcagagcgcctagtgcgtgccaggtccccagtgcttgagcaccatgg

SEQ ID NO: 70272 - DNA, 201 bp, Homo sapiens
tgcgtcgacacccctcctgcctgaagtggaagcctatctccaactcctcgtggtcatcttcatgatgaacagcaagcgctacaaagaggtatccaggatgyagtgagagcgattcataagccccaagtgatgcaaggggtttggcggggagatggtccctggtgaagaaatggaaataatcattgattcttaagaactgtc

SEQ ID NO: 70273 - DNA, 201 bp, Homo sapiens
tggcctcaagcattctcctgcctcagccttccaggtagctggcactaccggcgtgagccaccacacccagctcctccttgatttctttgggaaagactgtmatctttatttttttatccctagcacctaacaaaatcttggcacatggtagacactcaataaatatgttgaaatacatagtggatgctcaataaattcttg

SEQ ID NO: 70274 - DNA, 201 bp, Homo sapiens
gacctcccccagggctcctccccagccggtgacttactgtacagcaggcaggagggtgggcaggcaacctccccgggcagggtcctggccagcagtgtggsagcaggaggggaaggatagttctgtgtactcctttagggagtgggggactagaactgggatgtcttggcttgtatgttttttgaagcttcgattatgatt

SEQ ID NO: 70275 - DNA, 201 bp, Homo sapiens
tactaaaaatacaaaaaatttagccaggcgtggtggcgggtgcctgtagtcccagctactcgggaggctgaggcaggagaatggtgtgaacccagcaggcrgagcttgcagtgagccgagatcacaccactgcactccggcctgggcgacagagtgagactccgtctcaaaaaaaaaaaaaaaaaaaaaaagaactccttg

SEQ ID NO: 70276 - DNA, 201 bp, Homo sapiens
gcacaatgatctgcatatagtaagctttcgtgatattttcataaatggtagctgttattatggactaatagctccatttgcaaactgcacttctaccactccccagctagggccagcttctttgttcatcatagccactgtcacaggagcatactcaggaagtaagttgcactccttaattccctggtttgtttcctttcc

SEQ ID NO: 70277 - DNA, 201 bp, Homo sapiens
aaattgatttcatcacaattctggaggctctaagtccaagagcaaagtgtgacacgattggtttcttctgagggcctctctcgtctgcttgtcgatggccrtctcctggtgttttcacatggtcttccctctgtgcgtgtctgtgtcctgcttttgtcttagaaggacaatagtcatgtaggattagggtccacccatatg

SEQ ID NO: 70278 - DNA, 201 bp, Homo sapiens
atagttaacagtattcagcaaataaccagaaaagcaatttgtataacttttttaaggaattgagaaagagcgaagagttaaaggcagttcagagagttgtsatttgaaggctttgacatctttctttccttcttgaagcttcttgcatgctcggctccggacagctacgcttcggcatgacgcagacgggcaggccaccct

SEQ ID NO: 70279 - DNA, 201 bp, Homo sapiens
cacactccttcctctctcttctagccttggcccatcacctgtttgcttcagtctccgggaagaaaacccccagccctgctgcttcctctctcaggcggcckattcctgtctcccctggctccctccccaacagtgcactggccagccccttccctccagtgttctctctgctccttctcaccacctgggcctcagcagagc

SEQ ID NO: 70280 - DNA, 201 bp, Homo sapiens
ggggtggtgcataagaggcccatttggcaccctggcttgtcggtggggagttggatgaccctactctgttgaccaactctcctctcctccactcccagggsgaatcaaagccatccagctggagtactcagaggcccggagaacgatgaccaacgcccttcgcaaggcccctcagcacacagctgtcggcttcaaacagac

SEQ ID NO: 70281 - DNA, 201 bp, Homo sapiens
catcacactccttcctctctcttctagccttggcccatcacctgtttgcttcagtctccgggaagaaaacccccagccctgctgcttcctctctcaggcgsccgattcctgtctcccctggctccctccccaacagtgcactggccagccccttccctccagtgttctctctgctccttctcaccacctgggcctcagcag

SEQ ID NO: 70282 - DNA, 201 bp, Homo sapiens
ccatcacactccttcctctctcttctagccttggcccatcacctgtttgcttcagtctccgggaagaaaacccccagccctgctgcttcctctctcaggckgccgattcctgtctcccctggctccctccccaacagtgcactggccagccccttccctccagtgttctctctgctccttctcaccacctgggcctcagca

SEQ ID NO: 70283 - DNA, 201 bp, Homo sapiens
cacccgagagccccagctagccttccaccagcgcatctccttctgcctagatatccacaacatgtctgtcaaggtgagaagcccgtggctgcagagtcacrcctggcagcagcacacccctccctccacactcatggattcctcagagaagactggcttaatttgtggcccacgtcccagccaatctctgtaaaatcactg

SEQ ID NO: 70284 - DNA, 201 bp, Homo sapiens
gctatgttacctgggctggtcttgaactcctgggttcaagaagtcctcccacctcagcttcccaaagtgctgggatcacaggtatgagccaccatgcctgrcccctttgcctgttactcattccctaccacttcagttctcttctctatgctaggggctaggaaaggcatccttaaccttcctatccagaaggacttcaac

SEQ ID NO: 70285 - DNA, 201 bp, Homo sapiens
ctctgcaaaaattaaaaacctagctgggcgtgatggcatgcacctgtagtcccagctacttgggaggctgaggtgcaaggatcacttgggcccaggaagtygaggctgcagtgagccatgatcgtgccactgcactgcagcctgggcgacagagcaagactctgtctcaaaaaaaaacaaacattaaaattgaactggtct

SEQ ID NO: 70286 - DNA, 201 bp, Homo sapiens
tttccatggtaacttctgtcctctcctagcccatggacacagaggctgatttacagttccgtccccgcacgggaaaagctgcgtcgacacccctcctgccygaagtggaagcctatctccaactcctcgtggtcatcttcatgatgaacagcaagcgctacaaagaggtatccaggatgcagtgagagcgattcataagcc

SEQ ID NO: 70287 - DNA, 201 bp, Homo sapiens
gcgtcgacacccctcctgcctgaagtggaagcctatctccaactcctcgtggtcatcttcatgatgaacagcaagcgctacaaagaggtatccaggatgcrgtgagagcgattcataagccccaagtgatgcaaggggtttggcggggagatggtccctggtgaagaaatggaaataatcattgattcttaagaactgtcc

SEQ ID NO: 70288 - DNA, 201 bp, Homo sapiens
cagcaggacttggagtttgccaaggagatggcagaagatgatgatgacagcttcccttgagctggggggctggggaggggtagggggaatggggacaggcwctttcccccttgggggtcccctgcccagggcactgtccccattttcccacacacagctcatatgctgcattcgtgcagggggtgggggtgctgggagcca

SEQ ID NO: 70289 - DNA, 201 bp, Homo sapiens
gtaacacattattttttccagtgtcagtgacaacataggaaaatatgttttgtttatatgttgactttccctaaattttctttgttcccacaagaaaccaktttttggtctcattattctgatttcatctctagaattatttcgttcagccctgtccagtagtatttgcagtggatccaggtgtggtggtttaatgtctcc

SEQ ID NO: 70290 - DNA, 201 bp, Homo sapiens
gtcagctccgtggatggggaaactcagaacatccctggaggcagggcagtgaagagtttcttgtctgggaaaggggaaaagcgtactgttcccccaactcyaccttgaatattttctgaccttcacatcgctaaactcacgaaacgtgattattttgggggtgactgtaacacattattttttccagtgtcagtgacaaca

SEQ ID NO: 70291 - DNA, 201 bp, Homo sapiens
gtgcctagcacataaatatcagctgttattatttatatcattagtgtggcccagataccctgtgctaatcgctgaatatacagaagtgcctaagaaactaytcattgattgcattcccttattgctttgcatttaaactgtttctagtttcttgctatcataaatagctttgaagcaatcatctttgtgcccaacttaaaa

SEQ ID NO: 70292 - DNA, 201 bp, Homo sapiens
gcctactgggtgtgtttattacaggcacttcattttcttcttgtaaagtaattcatattcattgcagaaattgtggaatgtatgagaagttaaaagcaggrgataaaaaacatggttaacattttttcttgtgaatttttgagctgttctcctataattgagagcaagttatgtatacagtttgtatcaaggcataactaa

SEQ ID NO: 70293 - DNA, 201 bp, Homo sapiens
tgcatcatccaatctactcctgttctgcctgcagctgtcaggacaggaaacctagccaagttcaaccaggtcctggatcagtttggggagaagtttcaagyagatgggacctacaccctaattatccggctgcggcacaacgtgattaagacaggtgtggatcaggatctgaggggctgttggaggagcagaagccaggcc

SEQ ID NO: 70294 - DNA, 201 bp, Homo sapiens
ctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgt

SEQ ID NO: 70295 - DNA, 201 bp, Homo sapiens
aggcaggagaatcgcttgaacccgggaggttaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccac

SEQ ID NO: 70296 - DNA, 201 bp, Homo sapiens
ataggaagggaggataataagtgatctttctttcttttctttcgttttttgttttctgagacagagtctccctctgtcactcaggctggagtgcaatggcrcgatcttttctcactgcaacctctgcctcccgagttcaagtgattctcctgcctcagcttcctcagtagctgggcaggcgcctgccaccacatccaacta

SEQ ID NO: 70297 - DNA, 201 bp, Homo sapiens
agggctcctccccagccggtgacttactgtacagcaggcaggagggtgggcaggcaacctccccgggcagggtcctggccagcagtgtgggagcaggaggkgaaggatagttctgtgtactcctttagggagtgggggactagaactgggatgtcttggcttgtatgttttttgaagcttcgattatgatttttaaacaat

SEQ ID NO: 70298 - DNA, 201 bp, Homo sapiens
taggaagggaggataataagtgatctttctttcttttctttcgttttttgttttctgagacagagtctccctctgtcactcaggctggagtgcaatggcaygatcttttctcactgcaacctctgcctcccgagttcaagtgattctcctgcctcagcttcctcagtagctgggcaggcgcctgccaccacatccaactaa

SEQ ID NO: 70299 - DNA, 201 bp, Homo sapiens
cctcgtggtcatcttcatgatgaacagcaagcgctacaaagaggtatccaggatgcagtgagagcgattcataagccccaagtgatgcaaggggtttggcrgggagatggtccctggtgaagaaatggaaataatcattgattcttaagaactgtcccccacactctttccccatagaggtatgcgtttgatcccacatcc

SEQ ID NO: 70300 - DNA, 201 bp, Homo sapiens
tctactgaaaatacaaaaattagccaggcctggtggcaggttcctgtaatcccagctacttgggaggctgaggcaggagaatcgcttgaacccgggaggtwaaggttgcagtgagctgagatcgcaccaccgcactctcctgcctgggtgacagagcgagactccatctcaaaaaaaaaaaaaaagaagaagctgggtgtg

SEQ ID NO: 70301 - DNA, 201 bp, Homo sapiens
agaagactggcttaatttgtggcccacgtcccagccaatctctgtaaaatcactgagctgcagcacagggggcccagaatggggaggggacttggccatarttccatagccagttgccctctcctattgcgtttaagggatgatgtggtcaccagggaggaccaggcagggattcagagggcggggttctacatttggttc

SEQ ID NO: 70302 - DNA, 201 bp, Homo sapiens
acagctagagaaagcggtttcaggcaaggagccgagattcgtgctgcgggccctgcggatgctgccttccacatcacgccgcctcaaccactatgttctgyataaggctgtgcagggcttcttcacttcaaataatgccactcgagactttttgctccccttcctggaagaggtgagtgagtcaggccaacttaaagggtg

SEQ ID NO: 70303 - DNA, 201 bp, Homo sapiens
tacctgtggtagcatgaggagagaagccaaagcagtccatttgaatactcatctgcacagtgacaagggaaccgtccactgccctgtagtgtcattcttcmaagtcaggggatcaggaccctcccagccaaactcatttcccactaccctgcaacctgtaccccctactccagttgaggttgcgttgggtgacctctctgt

SEQ ID NO: 70304 - DNA, 201 bp, Homo sapiens
ccggagaacgatgaccaacgcccttcgcaaggcccctcagcacacagctgtcggcttcaaacagacggtgagccacaactaccatcatccctttgcctctttttttttttttttttttaaatggtgtcttgctatgttacctgggctggtcttgaactcctgggttcaagaagtcctcccacctcagcttcccaaagtgct

SEQ ID NO: 70305 - DNA, 201 bp, Homo sapiens
acactccttcctctctcttctagccttggcccatcacctgtttgcttcagtctccgggaagaaaacccccagccctgctgcttcctctctcaggcggccgrttcctgtctcccctggctccctccccaacagtgcactggccagccccttccctccagtgttctctctgctccttctcaccacctgggcctcagcagagca

SEQ ID NO: 70306 - DNA, 201 bp, Homo sapiens
cactccttcctctctcttctagccttggcccatcacctgtttgcttcagtctccgggaagaaaacccccagccctgctgcttcctctctcaggcggccgaytcctgtctcccctggctccctccccaacagtgcactggccagccccttccctccagtgttctctctgctccttctcaccacctgggcctcagcagagcac

SEQ ID NO: 70307 - DNA, 201 bp, Homo sapiens
gccaccacgcccagctaattttttgtatttttagtagagatggggtttcaccatgttggccaggctggtctcgaactcctgacctcaagtgatccacccayctcagcctcccaaagtcctgggattacaggcgtgagccaccgctccaggccaggtatttcttattattagagtatttcaaagagataaagaatgttgtgt

SEQ ID NO: 70308 - DNA, 201 bp, Homo sapiens
tgcgagctgccatgtctgcaaaaggttgcttcacatctatttgtgggtgtcaatgaagcagacactacctgcacctctggcagtggatattcagagtgttyctggcagataggtttagaatattcctgattccccagcgctcctgacagtcattccaggcttggacctagattgtgttgatacaaaccccaggtttttatc

SEQ ID NO: 70309 - DNA, 201 bp, Homo sapiens
aacagacggtgagccacaactaccatcatccctttgcctctttttttttttttttttttaaatggtgtcttgctatgttacctgggctggtcttgaactcstgggttcaagaagtcctcccacctcagcttcccaaagtgctgggatcacaggtatgagccaccatgcctggcccctttgcctgttactcattccctacca

SEQ ID NO: 70310 - DNA, 201 bp, Homo sapiens
tgttgaacctcctgctgcggaattacctacactacagcttgtacgaccaggctgagaagctggtgtccaagtctgtgttcccagagcaggccaacaacaaygagtgggccaggtacctctactacacaggtgagcagaggggcccaacccataaatcagaaggtgtctcaggcctgcctggtgcaaattttccaaggggtg

SEQ ID NO: 70311 - DNA, 201 bp, Homo sapiens
acccaggctggagtgcagtggtgtgatcttggctcacttgatcttggctcactgtaacctccacctcccaggctcaagtgatcctcccaccccagcctccygagtagctgggactacaggcttgcgccaccacacctggctaatttttgtatttttggtagagacgggattctaccatgttgcccaggctggtctcaaact

SEQ ID NO: 70312 - DNA, 201 bp, Homo sapiens
agcatataatactagctcaacacatgtttgcccgatcaagtcaccaataaacaaaagaatgagccagcttcctcccggttccttggcaagtgtgaataacyaagtcatttgtagttgacactcagctcagaggctgagggttctaaatgtatgtcccccaaagggattcatcttatgcacttcattaccagtcaagctatc

SEQ ID NO: 70313 - DNA, 201 bp, Homo sapiens; identical to SEQ ID NO: 52894

SEQ ID NO: 70314 - DNA, 201 bp, Homo sapiens
gaagagacacaaatctctacctcccatgttaagctttgcaggacagggaaagaaagggtatgagacacggctaggggtaaactcttagtccaaaacccaarcatgcaataaataaaactcccttatttgacagcttgattcctaacctcctgcttttttttctgctagggtgaaagaagcttaatctcagtttttttcagg

SEQ ID NO: 70315 - DNA, 201 bp, Homo sapiens
cacatccggccagtgcactcttaatacacagaaaaatatatttcacatccttctcctgctctctttcaattcctcacttcacaccagtacacaagccattytaaatacttagccagtttccagccttccagatgatctttgccctctgggtcttgacccattaagagccccatagaactcttgatttttcctgtccatctt

SEQ ID NO: 70316 - DNA, 201 bp, Homo sapiens
taatttttgtatttttagtagagacggggtttcaccatgttggtcaggctggtctcaaactcctgacctcgtgatctgcccacctcggcctcccaaagtgmtaggattacaggtatgagccaccatgcctggcctcttttctctcttaaggtcaccctggcatgtagtctggcctgactctgcctgtgtaaacacaaagga

SEQ ID NO: 70317 - DNA, 201 bp, Homo sapiens; identical to SEQ ID NO: 52901

SEQ ID NO: 70318 - DNA, 201 bp, Homo sapiens
tctacaagtcctttgtgtgtctaaatccttttttttttttcttttgagatggagtcactctttcgcccaggctggggtgcagtggcgcaatcttggctcaytgcaacctctgactcccgggtttaagtgattctcctgcctcagcctcccgaatagctgggattacaggcatgtgccaccatgcctggctaatttttgtta

SEQ ID NO: 70319 - DNA, 201 bp, Homo sapiens
ggagactggacaaagaagctggagaataggaactggagtttttaagaaaaattgttaaagaaaaagcagccgctggttttttgcaaatgctgtataaatckgtcatgccacagcagctgacagggccagaaaaactcaaatcccaggcccggtgtgtttcctccagccactcgcccaagaatgccaccgatgcccagatca

SEQ ID NO: 70320 - DNA, 201 bp, Homo sapiens
tgccctggacccctctatttatttcccttccacagtgtggtttcttcctctgcggtaaaggacttggtctgttctaccccctgctccagcttgccctgctygtcctgatcctgtgatttctctgtccttggctattcttgcagggagctggaaaacttcctgaggatttctggcctccccctgggttttagtttcagggca

SEQ ID NO: 70321 - DNA, 201 bp, Homo sapiens
gaagggcaaaaggaaccgggcccggttcatctctgggtctgttgcagtgaactgtgccggcacggggtcagcgcgatctccagcgtattgcgagttccccsatgggctgctagggccccattgcaggacccttatggactgcatgcagggtcgttgcacaacccccgccgggccagctgagtttcccagcgcattgctaag

SEQ ID NO: 70322 - DNA, 201 bp, Homo sapiens
gctgcctccatgcctgtggacattgccaagacccggtgagtgtgcagcctgggcctggaggtgggtgggagggtgccctttcggtctctcatgcccctgcrtcctctcctgcagaatccagaacatgcggatgattgatgggaagccggaatacaagaacgggctggtgaggaagccattctgggggcctgggagggggtg

SEQ ID NO: 70323 - DNA, 201 bp, Homo sapiens
acgccctgattcgaatcacccgggaagagggtgtcctcacactgtggcgggtgagtggaggggctggagacttgggggctgtgaggtctggttttaggggkttctgactcttccccgctcccctccctccagggctgcatccctaccatggctcgggccgtcgtcgtcaatgctgcccagctcgcctcctactcccaatcc

SEQ ID NO: 70324 - DNA, 201 bp, Homo sapiens
aaattggattgatgacaccagccccaaatctggagagtctggggggtggctaggagaggggaggagactggacaaagaagctggagaataggaactggagwttttaagaaaaattgttaaagaaaaagcagccgctggttttttgcaaatgctgtataaatctgtcatgccacagcagctgacagggccagaaaaactcaa

SEQ ID NO: 70325 - DNA, 201 bp, Homo sapiens
gtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggacagacttt

SEQ ID NO: 70326 - DNA, 201 bp, Homo sapiens
gacttaccaaagagcaactgaaacagattcctacacatgactatcagaagggtgagggggttaggggagaagagggcttttcccacagtttacctggttcwgaaggactttgagcccagaagatagggtatacaaagatggcagtggccgggcacagtggctcacgtaatcccaagtgcctctaatcccagtactttggga

SEQ ID NO: 70327 - DNA, 201 bp, Homo sapiens
tctgtttttatgcataaatacaacgaagacgggagaggagatggaaagcaaagatgattaagtgaaataattgtgggaaacaatagagggacagactttgyttataggggatgtggacagagcagaaaaatgggaggaatggggaggattcagttagagaaggaagaaaccggtaccaaggggctggggctttaggccctg

SEQ ID NO: 70328 - DNA, 201 bp, Homo sapiens
ttcccacctcctttggttccttagccccagctccccttgtttttcctgggccttcaacagatcccccactgtcccctccctcttcccctgttatcctggtytaataaccccccacacatacacctctggtgacctatttgcacagaccgtcgtcttccctccagtcttctgagggataggggacattccatcccaagcttc

SEQ ID NO: 70329 - DNA, 201 bp, Homo sapiens
ttagccccagctccccttgtttttcctgggccttcaacagatcccccactgtcccctccctcttcccctgttatcctggtctaataaccccccacacatamacctctggtgacctatttgcacagaccgtcgtcttccctccagtcttctgagggataggggacattccatcccaagcttctcccttacccacacctatcc

SEQ ID NO: 70330 - DNA, 201 bp, Homo sapiens
cagcctgggcgacagagggagtccctttctcaaaaaaataataataaaaataaagatggcagtaggaaggtttcagcttgagatgctgtcttttcttctgyttttatgcataaatacaacgaagacgggagaggagatggaaagcaaagatgattaagtgaaataattgtgggaaacaatagagggacagactttgcttat

SEQ ID NO: 70331 - DNA, 201 bp, Homo sapiens
ctgtcccctccctcttcccctgttatcctggtctaataaccccccacacatacacctctggtgacctatttgcacagaccgtcgtcttccctccagtcttytgagggataggggacattccatcccaagcttctcccttacccacacctatccttttgaggggctttggggtggggctggggcaagcagagggactgggtc

SEQ ID NO: 70332 - DNA, 201 bp, Homo sapiens
gtcttttcttctgtttttatgcataaatacaacgaagacgggagaggagatggaaagcaaagatgattaagtgaaataattgtgggaaacaatagagggayagactttgcttataggggatgtggacagagcagaaaaatgggaggaatggggaggattcagttagagaaggaagaaaccggtaccaaggggctggggctt

SEQ ID NO: 70333 - DNA, 201 bp, Homo sapiens
ggcctccagtgcccgtataaggctgtggcagaagccctgcccatttccgttccttccactccctatctccaccctcacacctccccaaaaacccacttccyttcttacctctgcttctctttgcttgtcccttctagccctaaattcttccatgttctgccctgaccttatcctgcctacctgtcttatctcttccactgg

SEQ ID NO: 70334 - DNA, 201 bp, Homo sapiens
ggtaggacatgtgcctccttcccattcttccttcagcaagcagttccatgccaacctggagcccaggcctcctcattacccgaaccattcagcctcctgtmcttccttccctgcctctttgactttcttcccattcctgtccccacctatgggctttgtccagagccagttactttgtccctctttttttctccctttgcc

SEQ ID NO: 70335 - DNA, 201 bp, Homo sapiens
actccgcttctgctccttgctaccaggacgcgcggcctcctcagcctctttcctcccgctgccatgcaccctgcagccttcccgcttcctgtggttgtggycgctgtgctgtggggagcggccccgacccgggggctcattcgagcggtgagtctgagggacggatggggaaagggcgctgaaaggaagggttgcaggctg

SEQ ID NO: 70336 - DNA, 201 bp, Homo sapiens
cagaccgtcgtcttccctccagtcttctgagggataggggacattccatcccaagcttctcccttacccacacctatccttttgaggggctttggggtggrgctggggcaagcagagggactgggtcttcacttcttgggctaataaaattgtttctttgtggactaaggaagggtaagatcattctcacacaggtgaact

SEQ ID NO: 70337 - DNA, 201 bp, Homo sapiens
aatctctctgagccttagtttgttttactgtaaaatgggatattagaagttttcctagggttattgtgaagatcaaagtagatacgcaattttggtagtayttcatcccaaagactgccacatagcaagaactcagttgggccttagtagcagtcgagttgtttgtgagatgggtaattagaaaattgaagaggccgggcg

SEQ ID NO: 70338 - DNA, 201 bp, Homo sapiens
tggtgtggaatagtggtaaggctgggggaatctatacagctgggctttcagtaggacccagagatggtgggaaggctgaaggcctcaggaaaagaagccartcctttaggtggggtggggccaaagtgcaagatgccagggttcccagaggatttgagtagaaggttgtgagtccccagagtaacaccttgatccctgcag

SEQ ID NO: 70339 - DNA, 201 bp, Homo sapiens
ctgcagccccattgccccaccacccccagccccggtcaatgggtcagtctttattgcgctgcttcgaagattcgactgcaactttgacctcaaggttgctraatgaggaaggggagctgggcagctgagggtaaaaaaaaggcaccaggaatgaagacaggtaaggcccatgatggctccttgtcctctgccttgtctccc

SEQ ID NO: 70340 - DNA, 201 bp, Homo sapiens
tggtcccaaggctaggtgtgaagttagccaaaaccccaatgcggacatggggtccccggccaggcttcacctttgcttcccttcgtgctcgaacctgccaygtgtgtcacaggcacagctttgaagcgaagctgacaccttggtgagcagccccaaagctgggggagaggaagaccccaataggcaaatagaaggaaggca

SEQ ID NO: 70341 - DNA, 201 bp, Homo sapiens
taaaagcctgggtctcagggttaggcatgtggggaaggtgggagagaagcccaccgtgggagccagcttctccctcctctctgtctgcaggatttaactcygggtttgctctcaaggatacgtggctgaggtctctgccccggttacaggtgggcaatgggggcaaaagggaacttctctcccctcctgcctggcccctcc

SEQ ID NO: 70342 - DNA, 201 bp, Homo sapiens
atatccacggatccaaccctaagtgactctcaaacctaccctctccctcaatttgtgacccagccccaaactccatcattgctctcctgtccctcaccatrtatcccttcttttgctcagtctgggccggggccctgtgccgctgaagacatggagtttgtgtctggataccgggatgagttccttgatttcactgccctt

SEQ ID NO: 70343 - DNA, 201 bp, Homo sapiens
ctcagcatgctgattccaggcccgggcttctccagacacccccgaggcaacacgccatccctcagccttcttcgcggtggtgcgtggggtctctccaggcrtgggccccttggcctagagggaaggactgggaagaagttgtctgggtcccagatgatccctccacatacacactgacccctaccaacagcaccagggcca

SEQ ID NO: 70344 - DNA, 201 bp, Homo sapiens
gaaaaaattagtcaggcatggtgcactcgcttgtggtcacaattctcgggagactgaggtgggagaatcgtttgagtccaagaggtcgaggctgtagtgtyccgtgatcacgccactgcactctagcttgggtgatagagcaagactctgtctcaaaaaaaaaaaaatgtctggggttctagcccagcacctcaactcctc

SEQ ID NO: 70345 - DNA, 201 bp, Homo sapiens
agagggtgtaagacaaacagaccgagtgacatatgggcagctgctgggcagttgaacagcagacaggacctacagaggttaacactaggtgcccaccaccygctgtgtccccagcccccagtgtagtgctgtcttgtattgtggagaggcttgtctccgggctgactggcagcggtgcccagatgatgtgagtcaccgatt

SEQ ID NO: 70346 - DNA, 201 bp, Homo sapiens
ctaccggggctgcccgccacgcagatccgagcccagggaaccccctcgctcccactcccataccccacagacgcatccaaaatgcttccctccccaccaarccgttcccgataggattagccctctctcctctctagccttaatttaaactctgcttttgagggtgtgaactctccaattttaagccccaaataccatctc

SEQ ID NO: 70347 - DNA, 201 bp, Homo sapiens
ggaaatgaatgctgataccctagtagtccccagctcccaaacactgaaaggaaaacgtgaaaacactcaaggcctagggggaggacaggttggtaaaacaygaaaaggtaaataaaattacttgtttgaaaccactgagtcatggatcttttgattacacgctcataattgggccattaaactgggaacgaagagaaagat

SEQ ID NO: 70348 - DNA, 201 bp, Homo sapiens
ttttggtgagctggaggggccctgtggaagctaggggtagggccagggactggagaaccagagcctgggtggctgtgaagaagaggtttgttagactagarggggtgggggtccagggccaggtcctctagcaaccctctcctgccaggctcatggcaggattactacacatggcggggcctcagcttggactcccccata

SEQ ID NO: 70349 - DNA, 201 bp, Homo sapiens
tggagaacgaaacaagaccccagaagaggaagggacagaggagtggtaagaacccagggctggccctgccctaccccttgcccagccatcctcccttcggragccctcccctgccactagttctgagtgctggccttcaggccaatctggcctgaaaaggtgtttttattgacccacagtggggtttttttttttaattta

SEQ ID NO: 70350 - DNA, 201 bp, Homo sapiens
cgtgctcgaacctgccatgtgtgtcacaggcacagctttgaagcgaagctgacaccttggtgagcagccccaaagctgggggagaggaagaccccaatagrcaaatagaaggaaggcagggtggtggggggcgcctagcagacagaaggagaggcagggacatgagaagatgcagaggaaacaatacagactgttacaggc

SEQ ID NO: 70351 - DNA, 201 bp, Homo sapiens
ggctagagcctagatccctggaacaagggcaggggctgggtgtttggggctggagacagggtctctgaagccgaggcctgagtgtctgggtccctgagagmgtgcagggattgggggacagggattcaaacacttacttgcttcccagctccaccactaactgcagtgtgaccttaaacaaaccactttacttcttgaagc

SEQ ID NO: 70352 - DNA, 201 bp, Homo sapiens
ccgaggcctgagtgtctgggtccctgagagcgtgcagggattgggggacagggattcaaacacttacttgcttcccagctccaccactaactgcagtgtgrccttaaacaaaccactttacttcttgaagcttccgtgtcctcatgagggatacggagaaggcccatggaattgttacaaggattatcttggcttggtgcc

SEQ ID NO: 70353 - DNA, 201 bp, Homo sapiens
acccccattcctcttactgcggctgtctcagggaatacagcccctttggaaggaagaaagagatgggtcaggtgggggtctccctgaccccaggcccctcyttctttcatcctctcaggagacccctaccagcttctccagggagacgggactgccctgatgcctcctgtgcccccacatccaccccggggtgtttttggt

SEQ ID NO: 70354 - DNA, 201 bp, Homo sapiens
tcacccctaccaactccacccagaaaccccatccctatgcaaacccccattcctcttactgcggctgtctcagggaatacagcccctttggaaggaagaargagatgggtcaggtgggggtctccctgaccccaggcccctccttctttcatcctctcaggagacccctaccagcttctccagggagacgggactgccctg

SEQ ID NO: 70355 - DNA, 201 bp, Homo sapiens
agctggaggggccctgtggaagctaggggtagggccagggactggagaaccagagcctgggtggctgtgaagaagaggtttgttagactagagggggtggsggtccagggccaggtcctctagcaaccctctcctgccaggctcatggcaggattactacacatggcggggcctcagcttggactcccccatagccgtgct

SEQ ID NO: 70356 - DNA, 201 bp, Homo sapiens
gttctagcccagcacctcaactcctccccttctccttctccagaggtgaccagtgaaaccttcaacaaagaggccttcctggcctctcggggcctcactcrtggctattggacccagctcagcatgctgattccaggcccgggcttctccagacacccccgaggcaacacgccatccctcagccttcttcgcggtggtgcg

SEQ ID NO: 70357 - DNA, 201 bp, Homo sapiens
agcggtgcccagatgatgtgagtcaccgattttggtgcccaaggcttgcagccttcatggagcgggcaggagaactggcaaccctgccttttacctacacygcaggtaccataaggaggtcagaatggttgggggaaactgggaccaggtctttgagactgggaattagatgtctgggaacagggtcctgcagttgaaggc

SEQ ID NO: 70358 - DNA, 201 bp, Homo sapiens
cccctaccaactccacccagaaaccccatccctatgcaaacccccattcctcttactgcggctgtctcagggaatacagcccctttggaaggaagaaagaratgggtcaggtgggggtctccctgaccccaggcccctccttctttcatcctctcaggagacccctaccagcttctccagggagacgggactgccctgatg

SEQ ID NO: 70359 - DNA, 201 bp, Homo sapiens
accctccactccacctgcgagacctgagcccctacatcagctttgtcagcctagaggatggggaggaaggggaggaggaagaggaggaagatgaagaagargagaagagagaggacgggggtgcaggcagcacagagaaggtggaaccagaggaggaccgggagctagcccctaccagcagggagtccccccaggaaacaa

SEQ ID NO: 70360 - DNA, 201 bp, Homo sapiens
caggatttaactccgggtttgctctcaaggatacgtggctgaggtctctgccccggttacaggtgggcaatgggggcaaaagggaacttctctcccctcckgcctggcccctccccatctccttttctgaaagtctctgggctctcctcctcttcaccatcacctgctccacaaacctggggagtgcccacgggtccccct

SEQ ID NO: 70361 - DNA, 201 bp, Homo sapiens
aataaagagaatctgctctcttcagccctgtgtctgtgcttgagtgggggcgagcacggggctgagactagaggtcggcctctgcctggaaagtcccgatstctgagcggaagtggagcgaagtgtggcgcggaagtgaggcgaaggctttccccatcgactgggcgcgccgagcggtctaagcgactgcgtctgatgggg

SEQ ID NO: 70362 - DNA, 201 bp, Homo sapiens; identical to SEQ ID NO: 53112

SEQ ID NO: 70363 - DNA, 201 bp, Homo sapiens
tggcatccggcccccgtggagagggctgaggctggggggctgttccgtctctccacccttcgctgtgtcccgtatctcaataaagagaatctgctctcttmagccctgtgtctgtgcttgagtgggggcgagcacggggctgagactagaggtcggcctctgcctggaaagtcccgatctctgagcggaagtggagcgaag

SEQ ID NO: 70364 - DNA, 201 bp, Homo sapiens
gctttgggaagcttggggctgggggagaggctgtcaggggaacctagaacctagcttatgcccccttcccagatgtgacactcagtgctctgaacgactcygatgccaacagtgacgtggtggatattgaagggctaggagaaactcctccagctaagaaactcaacttcgaccagggtaggagtcctcctcctcccacac

SEQ ID NO: 70365 - DNA, 201 bp, Homo sapiens
tcacccaagaaagggcccaagaaggtggcatctggtgtcttgtcacctcctccagctgcccctcctcccagcagctccagtgtccctgaggccgggggtcyccccataaagaaacagaaggctggtgagggctgtggagttgctgcctaggggttaaaggtcccatctgaggtttagtgagagaattgggcctgggtcaaa

SEQ ID NO: 70366 - DNA, 201 bp, Homo sapiens; identical to SEQ ID NO: 53130

SEQ ID NO: 70367 - DNA, 201 bp, Homo sapiens; identical to SEQ ID NO: 53132

SEQ ID NO: 70368 - DNA, 201 bp, Homo sapiens; identical to SEQ ID NO: 53117

SEQ ID NO: 70369 - DNA, 201 bp, Homo sapiens; identical to SEQ ID NO: 53119

SEQ ID NO: 70370 - DNA, 201 bp, Homo sapiens
atgtggttaggagccagggagtcagacctcagcggccatcccaaacccaccaccttaggtgtgacctctttaggtattttacttttctgtgcttctcagtmcacctctgcaaaatggctatgacagatctcaccccataggatggtcaagaagattgaataaagtaatacacgtaacagcgcctaaacaggtgtcgggcac

SEQ ID NO: 70371 - DNA, 201 bp, Homo sapiens
aaaaagaaaaaagggaactggagcggagggccctggagtgggaggagccagggctggtaaaggtggagacccctcaaggtaggagaaacaagagcggggtkcctgagaggtgcttgagttgaatggaggacatgggaggaaaagagagtgcttgttccagaaatgtgtagctgggccttgttttcccagtaatccacccac

SEQ ID NO: 70372 - DNA, 201 bp, Homo sapiens
tcaatccacctgtaaatcaccaagctctacctgatgtctctcccagaagagaattaggagatgggcctttcccactactcagttcagggactccactctcyacactccatccatcctgagtgagtgtaaaacttcgagaaagtgagaaccctaccaatgggttggggccccgacctggattcttatgaagggactcccaga

SEQ ID NO: 70373 - DNA, 201 bp, Homo sapiens; identical to SEQ ID NO: 53077

SEQ ID NO: 70374 - DNA, 201 bp, Homo sapiens; identical to SEQ ID NO: 53109

SEQ ID NO: 70375 - DNA, 201 bp, Homo sapiens
ccccataggatggtcaagaagattgaataaagtaatacacgtaacagcgcctaaacaggtgtcgggcacatagtgctcagaaaatgttggctcctattaawgtttgacccctttgcttcattcccacccccaggaatggcccccagaacatatacaacctttacgagcaagtcagctacaactgtttcatcgctgcaggcc

SEQ ID NO: 70376 - DNA, 201 bp, Homo sapiens
tggcaaatgtttctgtgagtctgggactaggagatagaattcctgagagtgctcattttaactatataacatagattacagtacctttttcaaatcctaaratgatgacatcctacctctggaggaaaccagagtgaaggccatggagaaagggctgccatccctgtccatctttcacccagccatgagagaagacagggt

SEQ ID NO: 70377 - DNA, 201 bp, Homo sapiens
tgtagttctcggggccaggggagccggcacggaagcggctgtgcgcatgagcagatgaggcctagccgaggcggcgggacccccaagtttggaaagctctkttaacggtgagaacgcgttaacacttgccaaggggagtggttggtgcctgtgcggagctagcagccggcctgaggagggagggagaatgtgatccggtgg

SEQ ID NO: 70378 - DNA, 201 bp, Homo sapiens
tcctgttctgctttgatattcatgaacattttagctctccatgagtctgaaagtttttcctctattctgatgtcacaatctccaaagttatcagaaacctkcattcaagagcccctgttagagttttaagatgatgattattatttatttatttatttttagactactcttgctctgtcgcgcagggtgaagtgcaagtgg

SEQ ID NO: 70379 - DNA, 201 bp, Homo sapiens
agcagtatactaaattgttaaaagctgtcaatagctcaaaagagaagtttgaagactctgaaaaacaaaacaaaggatcagcaacgttttaagcaaaaggycaaaaaaattagttcaatccatgcagttaattcctgttctgctttgatattcatgaacattttagctctccatgagtctgaaagtttttcctctattctg

SEQ ID NO: 70380 - DNA, 201 bp, Homo sapiens
gccaagccttgccatggatttgtaccatcaaatatctatgagttgggtgaatttcctctcctcttgaggttccaggataaacctggggctcctgggcctgycataaagtaacattctttacttaacacaagtcagaaaccctgttcagggactgtgtacacaaaatatgaggccagtttcccaagggcgttattggcttca

SEQ ID NO: 70381 - DNA, 201 bp, Homo sapiens
gcaaataatggctgataatacctacgcttggggatgtctttcaccttgcaaaaaatctgggagctggaagagcctggctctagagactcaacaggtgcctygcagcttctgcctccttcccttggcccaaaggccagccagatagctgggggagttactttctgcaagcactgcctctggtctgagcctgatgggaagttg

SEQ ID NO: 70382 - DNA, 201 bp, Homo sapiens
gaacaaaggaaggaagaaataacttgtggaatgctgagaaaggtaaaaacaccttcaaataaggaagaagaataggctatgacttaatgcttgcttggacyagtataagcatgccagggcaaatatttaggctaaattgtgggagctaagaacataaagtacagtgacttcttcattatggctagcagatatttaagaatg

SEQ ID NO: 70383 - DNA, 201 bp, Homo sapiens
cagcttctagaggccacctccattcttccatcttcaaagccagaaacagcatctctctgagcccgattcctcacatctctttctctggctctgggcttccrcctttcttttccacttttaaggacccttctgatgacattgggcccacccagacagtccaggatcatctccctctctgctgatcagcaaccttaattctac

SEQ ID NO: 70384 - DNA, 201 bp, Homo sapiens
gtctcagccttcatccaccgctgagcaggtcaccttgcctttttcctgcagagagtgtaatcggcagcagaaggtcatccccgtggtgaacagcttctatrccgccacattcctccacctcgcacatgtctggaggacacagcggaagaccatctcagactcgggctttgtcctcaaaggtgtgctctttcttctggggag

SEQ ID NO: 70385 - DNA, 201 bp, Homo sapiens
gtggctgaggtggagatgaaagtgacaggaggaaagatcacttggtggtcttttaggctgttgtaaacatttactgtaagtgatatggaaaacactggagtgatgtgacagaatctggcatttttgggttttttcctctctaaaaaatatttatgaaaattttatcatatattattttactttctgagtgaaacagaatca

SEQ ID NO: 70386 - DNA, 201 bp, Homo sapiens
ccttccattccctcaaggaaccagaagctatttaggaatttaagaaagatataagctggaaaaagaaggaatatttgggggaataaacgctaggggtgggstgggtgctgggcatagtggctcacacatgtaataccagctctttcggaggaggctgaggtgaggggtcacttgaacccaggagttcaaggctgcagtaag

SEQ ID NO: 70387 - DNA, 201 bp, Homo sapiens
aacagaggtgtatggttgggggttcctatacagggtgtaagaagggaaaagtggaaattaggaaaggcccttaaacaaactggttgcatgctcttatgtgrgtacccaccccaggcagtgacttgccccctcgtagatgagagcatttagggatcacctcgtggggcagatccgccccatacccaccacagaggctgacct

SEQ ID NO: 70388 - DNA, 201 bp, Homo sapiens
gatcatatttttggtattaaactggagtctctccatccttcacattgttgatgtcctctgtagcaaaccggaaaagtcagtgacagaagatgccgctagcrgtttgagccagagaatgacagctctggtttggagaaaagggccggatggtggctctagaaagcccatccttctgctcttctttttttctcccccttatat

SEQ ID NO: 70389 - DNA, 201 bp, Homo sapiens
ctctgcctagcacataccaaaactctggaatcacagagggaaagctggtgttctgcataaagtatcttttttgtgtttgtttttttgaaaaaaaaaaaaawtttttgtagagacaggatctcaccatgttgcccaggctggtcttgaactcctagactcaagtgatccatccgcctgtaatcccaaagtgttggattgtga

SEQ ID NO: 70390 - DNA, 201 bp, Homo sapiens
caatctggcagagagtgtgggtgtgttttggggcaggtggcctggatagccaagacccagtgcatggccgagtcctccagaccatctataagaagctgacyggctccaagtttgactgtgcccttcatggaaaccactgggaggacctgggctttcagggtaagagggaggagtagctcatcttctttttcatgcctctga

SEQ ID NO: 70391 - DNA, 201 bp, Homo sapiens
aggtggtcagagcccaagaagaatgggaagctgtggacaccatccagccagagacaggtaactgtacgaatgctgctgtctccccatagcccctctgccascaaaggcaccatccacacatgtggcaaatgtttctgtgagtctgggactaggagatagaattcctgagagtgctcattttaactatataacatagattac

SEQ ID NO: 70392 - DNA, 201 bp, Homo sapiens
ggagacagaggttgcagtgaaccgagatcacgccactgccctgcactccagcctgggcgacagagcaagactccatctcaaaaaaaaaaaaaaaaaaaaaatctgtctcttggagttgttgtaatgattagtgacttaactctacccagtgtggcactagcgctggatttccaagaccacctgcaggttcaatgattcctg

SEQ ID NO: 70393 - DNA, 201 bp, Homo sapiens
gatgggaagttgattaagggaaatgaaccagcattctgcccattgcctgcaacttcttccccagaaaagaatccagccaactattcgaaggactgggctcrccgccctccgacactacctcttcgggcctccaaagctccaccagcgccttcgggaagaaagggacttggtcctgaccattgctcagtgtgagtgcaatgc

SEQ ID NO: 70394 - DNA, 201 bp, Homo sapiens
gagcccaagaagaatgggaagctgtggacaccatccagccagagacaggtaactgtacgaatgctgctgtctccccatagcccctctgccagcaaaggcaycatccacacatgtggcaaatgtttctgtgagtctgggactaggagatagaattcctgagagtgctcattttaactatataacatagattacagtaccttt

SEQ ID NO: 70395 - DNA, 201 bp, Homo sapiens
ccagagagcccaaggtggttgctagactggttttggctgcagttcttccccatccacactttctcaaattccagcttaccaaaatctccatcacccacccsctggagtctgctagttctcctttctctgccctgactgtcgcccttttctggtcttatacttatgacaagcatatattctgatcaaaaattgggagccagg

SEQ ID NO: 70396 - DNA, 201 bp, Homo sapiens
tgcaccggtctccccaggacatcccttctcccacccctggccttagatgtcaggctcctggggaatggtgggggcatcctgggtttgggctggctcccctsgggaaatggggaaggaaggcgggagggaacctaggtctcagccttcatccaccgctgagcaggtcaccttgcctttttcctgcagagagtgtaatcggca

SEQ ID NO: 70397 - DNA, 201 bp, Homo sapiens
ctatcctcaagctaaaggtcagctgcctctacagatctcagagttgaagaaccatggcattctccaggctctgaccacagaagcttatgaatgggagccaygtggtaaggttcccttcagggcccttggagtctgggtgggacccaagtcagaccttcccatgcatctgctgttcatcatttgaatttctctcactccttg

SEQ ID NO: 70398 - DNA, 201 bp, Homo sapiens
ctgagacaggtctcagttaatttagaaagtttgtttttccaaggttgggaatgcgcacctgtgacacagcctcaggaggtgctgatgacatgtgcctaagktcatcagagcacagcttggttttacagttttagggagatatgagacatcaattaacacatgtaagatgagcattggttcctccggaaaggtgggaggact

SEQ ID NO: 70399 - DNA, 201 bp, Homo sapiens
ggacacatagaagggaacaacacacactggggcctattggaaagtggagggttggccgggcccggtggctcacgcctgtaatctcagcactttgggaggcygaggcgggtggatcatgaggtcaggagatcgagaccatcctggctaacacggtgaaaccccgtctctactaaaaatacaaaaaaaattagtcgggcctgg

SEQ ID NO: 70400 - DNA, 201 bp, Homo sapiens
gattttaaaagaacacgttgaaaaattagctctgtatctgtgaaatgagttacaaacaattggccgagtattttggtcggttttttgtttttcatctgtarcaggggataggtttggctgagcagaaaggccataggaaactgcttcactaaacttcgctcactcagaaccctcagactttcaaagagccaggaaatcggt

SEQ ID NO: 70401 - DNA, 201 bp, Homo sapiens
aggcaggcggatcacgaggtcaggagttcaagaccagcctaaccaacatagtgaaaccccatctctactaaaaatacaaaaattagcagggtgtggtggcrcacgcctgtaattccagctactcgggagactgggacaggagaatcgcttgaacccgggaggcggaggttgcagtgagccgagatcgcacggctgcactcc

SEQ ID NO: 70402 - DNA, 201 bp, Homo sapiens
cggagctagcagccggcctgaggagggagggagaatgtgatccggtggaaattatcactatggggcgagacaaggccgagagttgtaagactgaaagagartcccgactgggagacaggagtcctgagttctggtcctggctctgccctggactcgctgccttgaggtgttaaattgctttcctcgtcttacgcctccagg

SEQ ID NO: 70403 - DNA, 201 bp, Homo sapiens
cctctgcctagcacataccaaaactctggaatcacagagggaaagctggtgttctgcataaagtatcttttttgtgtttgtttttttgaaaaaaaaaaaawatttttgtagagacaggatctcaccatgttgcccaggctggtcttgaactcctagactcaagtgatccatccgcctgtaatcccaaagtgttggattgtg

SEQ ID NO: 70404 - DNA, 201 bp, Homo sapiens
gagactcaagggactctacgtatagttatacttaacagttctgatttagtacaacagaagcaaaatcagcaaagggaagaattacatgggacaaattccayaggaaaccaggtggtgatgtccaagaggcctctcccagtggaatcacacagaacacacttcattcttccactgccaaattgtgcaatacgtataaaatgt

SEQ ID NO: 70405 - DNA, 201 bp, Homo sapiens
cccaaacaccagctggttagagtgacccagcaaagccttgttcgtccccactctggcttaattttccccagctctactccacctgctggctcctggagggyctggacaaagtccccatgcaccggtctccccaggacatcccttctcccacccctggccttagatgtcaggctcctggggaatggtgggggcatcctgggt

SEQ ID NO: 70406 - DNA, 201 bp, Homo sapiens
ccgctgagcaggtcaccttgcctttttcctgcagagagtgtaatcggcagcagaaggtcatccccgtggtgaacagcttctatgccgccacattcctccayctcgcacatgtctggaggacacagcggaagaccatctcagactcgggctttgtcctcaaaggtgtgctctttcttctggggaggcctaggctgaatgcac

SEQ ID NO: 70407 - DNA, 201 bp, Homo sapiens
cttcagctggctcattgggaaaattagagacaatgtacaaaagtagcaagcacagctgtgctgttgctgtttcaactctctgccctccctgaggaaatgcyttgcacaggggtagcatctcttggccctgaaagagaagagttagcctccacgggcccaagaggaggagatggacctccatgggttatgtgagccacagac

SEQ ID NO: 70408 - DNA, 201 bp, Homo sapiens
ggcaccatccacacatgtggcaaatgtttctgtgagtctgggactaggagatagaattcctgagagtgctcattttaactatataacatagattacagtayctttttcaaatcctaagatgatgacatcctacctctggaggaaaccagagtgaaggccatggagaaagggctgccatccctgtccatctttcacccagcc

SEQ ID NO: 70409 - DNA, 201 bp, Homo sapiens
ggcccaaggcaggcagacaaggctggggtctgcagtagaggcccagacatacctagatctcagagggtctccttttctcctactattgcagttgtgagtayagaggtggtcagagcccaagaagaatgggaagctgtggacaccatccagccagagacaggtaactgtacgaatgctgctgtctccccatagcccctctgc

SEQ ID NO: 70410 - DNA, 201 bp, Homo sapiens
cagttcttccccatccacactttctcaaattccagcttaccaaaatctccatcacccaccccctggagtctgctagttctcctttctctgccctgactgtygcccttttctggtcttatacttatgacaagcatatattctgatcaaaaattgggagccagggtccaatagttggactattcaaagttgcaattgtgcaga

SEQ ID NO: 70411 - DNA, 201 bp, Homo sapiens
cggccaatcttacttttcaaaagctcactctagcaaacctgtgaggagaggatcagagggtgttaagatccaaggcagccagatgtggtagtgcgtgcctrtagttccaggtactcaggaggctgaggcaggaggattgcttgagtccaggaattctgggctgtagtgtgccatgctgatcatgtggccccactaagttca

SEQ ID NO: 70412 - DNA, 201 bp, Homo sapiens
tagatgcccacccagtgggagtagcacgcagtgagctttatttaggtgctgctttgaatggcaggcttgcatacaagggaagtccctcatagcataagccytttggaggctgaggttccaggagtcaccatcaagagggagaggccggcaagggaactccccgggcagagggggatcagagagggggcttacatgtctagg

SEQ ID NO: 70413 - DNA, 201 bp, Homo sapiens
ctgggcgacatagcaagactccatctctacaaaaagtaatttttttttttcttttttgagacagagtctcgctctctcgcccaggctggagtgcagtggcrcgatcttggctcactgcaagctccgcctcctgggttcacgccattctcctgcctcagcctcccgagtagctgggactacaggcgcccgccaccacgcccg

SEQ ID NO: 70414 - DNA, 201 bp, Homo sapiens
agtttcacgagtctgcaaagcagacaggctctcagtggctaaaattttgcttacttggtctgtgtgtaaaacaaacggatgtgtaaaactttgagtttggygctagcggtcttttaaaagagctagaccaggtgcggaggcactttgggaggccaaggtaggaggatcgcttgaggccaggagttcgagaccagcctgggc

SEQ ID NO: 70415 - DNA, 201 bp, Homo sapiens
gggtttcactgtgttagccaggatggtctcgatctcctgacctcatgatccgcccgcctctgcctcccaaagtgctgggattacaggcgtgagccaccgcrcctggcctacaaaaagtatttttaaaaattagccaggcgtggcggtgaatgcctgtagtcccacctacttgagaggctgaggtgggaggattgcttgagt

SEQ ID NO: 70416 - DNA, 201 bp, Homo sapiens
tgtaatcccagctacttgggaggctgaggcaagagaatcacttgaacccaggaggcagaggttgcagtgagctgagattgtgccactgcactccagcctgrgtgacagagcgagactccatctcaaaaaataaaaaaaagaagtgacatgtgagcagagacctgcaagaacctgagaatgagagaaagccatagagacaga

SEQ ID NO: 70417 - DNA, 201 bp, Homo sapiens
gcagaagaacagttattaggcaatgactgtgtacctggcccagaacactttatctttatttatttatttattttttgagacagggacagtctttgtctccygggctggagtacagtggcgcagtcttggctcactgcaacctccgcctaccgggttcaagcaatattcctgcctcagcttcccgagtagctgggattacag

SEQ ID NO: 70418 - DNA, 201 bp, Homo sapiens
cgcggcagtgaccaccagggagcggtacacagggggcggggccatggggactggggttctttttttcttttctttttcctttttttttttttttttttgaracagagtcttgctctgttgcccaggctggagtgcagtggctcaatctcggctccctgcaacctccacctcccgggttcaagcgactgtcctgcctcagcc

SEQ ID NO: 70419 - DNA, 201 bp, Homo sapiens
ggaggccaaagcaggcggatcacttgaggtcaggagtttgagaccagcctggccaacatggtgaaaccccaactctactaaaaatacaaaaattagccagrtgtggtggcacatgcctgtagtcccagttacttagggggccgaggcacgagaatcatttcaacctgggaggtgaaggttgcagtgagccaagatcatgcc

SEQ ID NO: 70420 - DNA, 201 bp, Homo sapiens
cctcaaaccagacaagtgagctgagctagcatgagcggggcctcgcggagggcggggccagagaggatcaggggcggggccaaagaggatcagggcagagyctctgaggtgcatcccgggacccttcaggagccccatctgtctgagctctgttggtacctcctgacaggaaggcagggaatgagcgcatggtgaacatct

SEQ ID NO: 70421 - DNA, 201 bp, Homo sapiens
caagtaattctccctgcctcagcctcccgagtagctgggattacaggcacatgtcaccacgcccggctaatttttgtatttttagtagagacggggtttcrccatgttggccaggctggtatcaaactcctgatctcaggtgatccgcccacctcggcctcccaaagtgctagaattacaggcgtgagccaccgcgcccag

SEQ ID NO: 70422 - DNA, 201 bp, Homo sapiens
tagtcctagctacttgcggggctgaagtgggaagactgcttgagcccaggggtttgaggctgcagtgagctatggtcgcacaactgcactccagcctgggygacatagcaagactccatctctacaaaaagtaatttttttttttcttttttgagacagagtctcgctctctcgcccaggctggagtgcagtggcgcgatc

SEQ ID NO: 70423 - DNA, 201 bp, Homo sapiens
ctcctaccttcgctgaaaggagcttcagtgaagaccgggaggaggggtgggagcgcagcgaagtggactatggccgccggctgagtgctgacatccggtargtggcctggggaagtgtaggcagatccagcttccaagcctgctgggaggtagagacacaaaatctgatgcaaagggagcttcctagtggccaagtagaaa

SEQ ID NO: 70424 - DNA, 201 bp, Homo sapiens
cagcggccaccccagtgatgcccaagccctcgagcctttctggtaagtggggccctgagtaagagggatgatgtcatggaagtttcccagaggaggggctrtttgagatgggttttcaaggatgagtaggagttctccagagccaacaaaggctttaagagaggagaagccagggtcccagagagacccccagcccccaag

SEQ ID NO: 70425 - DNA, 201 bp, Homo sapiens
atcacttgagaccaggagttcaagaccagcctgggcaacatggtgaaacctcatctctataaaaaatacaaaaattagccgggtgtggtggcacatgcccmcaatcccagctactctggaggcggaggttgcagtgagccaagattgcaccactgcattccagtctgggcgacatagccagacgctgtctcaaaaaaaaaa

SEQ ID NO: 70426 - DNA, 201 bp, Homo sapiens
acatcaagctcacggacttcggcctgtccaagatcggcctcatgagcatggccaccaacctctatgagggccacatcgagaaggacgcccgagagttcatygacaagcaggtgggcgggcaggtgggtgggcagccccgggatgcctcctcctctctcctgggacctctcttgggctgggggctggcctcagtttccccgt

SEQ ID NO: 70427 - DNA, 201 bp, Homo sapiens
ccagcagaaaatcatctctcagctaggcacggtggctcccgcctgtaatcccagcactttggaaggctgaggcaggcagatcacttgaggccagaagttcragatcagcctggccaacatggtgaaaccccgtctctactaaaaatacaaaaaaattaaccaggcgtggtggtgctcgcttgtaatcccaggtactcagga

SEQ ID NO: 70428 - DNA, 201 bp, Homo sapiens
aagctgtgggcagagtgttggaccgtgaatcaatgaggactgccgagggcaaagtcctggaccttggggcaggacagagccaaagactccacaagggatgwccactccctgccaccttccctgtgccccactgggtccaccggggcctcaagagggccagagtgagacacagacacccccagaccgtggggtttgcgctga

SEQ ID NO: 70429 - DNA, 201 bp, Homo sapiens
tggaggtaagtgacagcgcgtgtgggcggggcgcagacatcgccctggcaccccagagccttggaaaccctccagactcatcggtctcctcaagatactgyaggttggtgacatcacctctctgggcctcagtttacccctccacataatggcactgcgatacgttctaggggcttaatgggaaaattccatttttagcca

SEQ ID NO: 70430 - DNA, 201 bp, Homo sapiens
ctggactcctgggtggtgacctcagggagaaagctcctccctctaaaacacacgcacacccaaggctgagaggccaccaacgagagccctgtgaattgagmttaaccaaagtggcgccgggagaaaagaaccagggtgactgagcgctccctaaccctttcctgatccctacttcccagttaagaaaactgaggctcagag

SEQ ID NO: 70431 - DNA, 201 bp, Homo sapiens
cctgggtggtgacctcagggagaaagctcctccctctaaaacacacgcacacccaaggctgagaggccaccaacgagagccctgtgaattgagattaaccraagtggcgccgggagaaaagaaccagggtgactgagcgctccctaaccctttcctgatccctacttcccagttaagaaaactgaggctcagagaggagat

SEQ ID NO: 70432 - DNA, 201 bp, Homo sapiens
caaacccctctgcctcagcctccccaagtgctgggattacaggcataagccacacgctgggccatccacagacctttaacggggagaagagagaacaatayagagcccacatttgggtgctgggcaacagggaggtaccttccttcagacgccaagcacttatgaggcacctactgagatccaggtgctaaaggcattgct

SEQ ID NO: 70433 - DNA, 201 bp, Homo sapiens
catgatgaagggagggacccgtgtgttggaggccgctgagcagatttgaccagttttaactgggaggggagggaggaagtatctgggactgagaaaggccrtaaggctgcctcactcaccaccggggggcagcagagccacattgccttgggcctggcgggggaatgggtccctgcctgccatgttccaagcatcctagga

SEQ ID NO: 70434 - DNA, 201 bp, Homo sapiens
aactcctgacctcaggtgatccacccgccttggcctcccacggtactggaattactggcatgagccattgtgcctggccttgcaacttccctgcttccatyctatccatctccccgtcgctcacttggctccagccacatggctgatcctccagaatgcaggctggtccagcctcagggcctttgcacttgctgtccccac

SEQ ID NO: 70435 - DNA, 201 bp, Homo sapiens
ccgagtgtgtgcaaaggtgtgtccccgtgcatatggggtggctcagcacgtagtgacagcaagtggagactgtggccccatccccacttgggtccccagaytcaagagaatctgcaccccgcatgaggcttgggctgcatacctgggggtcataggtgaccactcccatactcatcaccatctctggtggtctcaaaacca

SEQ ID NO: 70436 - DNA, 201 bp, Homo sapiens
cctcccagacaccgtcccagacccttactggcctcctgctaccttcattcctgtcccccagcagtctgctccccatagcagacacaagggggtttacaaaygtagtccacatcataccctttctctgctcaagcaccctccatggctccccattgctcctacaatacaattgcactcctccctgcagcccacaaggcttat

SEQ ID NO: 70437 - DNA, 201 bp, Homo sapiens
cgtcctctatgagtttctggtgggctgcgtgcctttctttggagatacccccgaggaactcttcggtcaggtggtcagcggtgcgtttcctccatgggccygggtttgagctgcagccccaccagagctctgggcagcggtcctccacccgcatgtcagggagagaagcaggaagaggggagggagttggatgccaggtgg

SEQ ID NO: 70438 - DNA, 201 bp, Homo sapiens
aagtgacatgtgagcagagacctgcaagaacctgagaatgagagaaagccatagagacagaaaagagaaaggtggctctgagcatagggcacagctgtggsaaaggctgtcagtgggtaccaagcctgccacgttgcaggggcagaggaggccagtggcttggagtacagtgaagtgaggggaaatggtggatggtactag

SEQ ID NO: 70439 - DNA, 201 bp, Homo sapiens
agtgaccccctccctaaccccctgcagatgatggcagcggcggccccctcatgagccccctttccccgcgctctctgtcctcgaacccgtcgtcccgtgaytcttcgccgagccgagacccgtcccccgtgtgtggcagcctgcggccccccatcgttatccacagctctggcaagaagtacggcttcagcctgcgggcga

SEQ ID NO: 70440 - DNA, 201 bp, Homo sapiens
ggccgcatggcacgcaggagcaagaggagccgtcggcgggagacccaggatcggtgcgcggcagtgaccaccagggagcggtacacagggggcggggccayggggactggggttctttttttcttttctttttcctttttttttttttttttttgagacagagtcttgctctgttgcccaggctggagtgcagtggctcaa

SEQ ID NO: 70441 - DNA, 201 bp, Homo sapiens
taggcagaagaacagttattaggcaatgactgtgtacctggcccagaacactttatctttatttatttatttattttttgagacagggacagtctttgtckcccgggctggagtacagtggcgcagtcttggctcactgcaacctccgcctaccgggttcaagcaatattcctgcctcagcttcccgagtagctgggatta

SEQ ID NO: 70442 - DNA, 201 bp, Homo sapiens
gtgagctgagatcgcgccactgcgctccaacctgggcgacagagcgagaccctgtctcaaaaaaacaaaaaaagaaagggcagatgaagccaggattcaarcccaggcccatccgattccagaaccaccgcactgttctttgtctctctgtggccttgctcttaggtcacctgtgggaattatgctgagaccctctgatct

SEQ ID NO: 70443 - DNA, 201 bp, Homo sapiens
cccggctcgcccacccacagcctctcccccagccccaccactccctgccgaagcccagcccctgatgtcccagcaggtgggtgcaccccgaccccccaccrccccggctaccctgggagcaagggctggtgggccccaggagggaggaaggagctcaggggatggaatgacacgatgtagggaaaaagatgaccgggatcc

SEQ ID NO: 70444 - DNA, 201 bp, Homo sapiens
cccagcccctgatgtcccagcaggtgggtgcaccccgaccccccaccgccccggctaccctgggagcaagggctggtgggccccaggagggaggaaggagytcaggggatggaatgacacgatgtagggaaaaagatgaccgggatcctggtgtctagcagggaacctgggagtacttagagacgaatgcaggtgccaggg

SEQ ID NO: 70445 - DNA, 201 bp, Homo sapiens
tcccttcccggcctcaggcggctgcggcggcacaaagggaagcagcatgtccgaccccagctactggacggcggtggcggctcccggccatcggagccgcytggcaaaaggcgcgctgctgcagcgctccaagaggtagggggcacggcgccggcgaaggctcggcggccagccgagcaaacaggagttgccagaagtgtg

SEQ ID NO: 70446 - DNA, 201 bp, Homo sapiens
gagggagcgattagatttacattttagcagaaaggagccaaaatgcctgcccctagctcgaggttaaggtgctgccaacgccccgcccccgccgcccgcgrtcgtagcaacgcccggcctcagccgcccgcggccctagcaacgctccgcctctccgcccgcggccatggcagcgccccgcccactcgccggcacgcgggt

SEQ ID NO: 70447 - DNA, 201 bp, Homo sapiens
tggggttggtctcaggtcccatatcacaagccagctgtcttcctttcagcccgggccgtgcaacggggaccttcgacaatgagattgtcatgatgaatcaygtgtaccgggagaggttccccaaggtgggcagcgcctggcggctggaccagcccctgcacttctttccacattgctgtccctccatggaactctgtcttc

SEQ ID NO: 70448 - DNA, 201 bp, Homo sapiens
aaaaaaaacaaacaactcccacagccagccaggtgcagtggctcacgcctgtaatcccataatcccagcactttgtgagactgaggcgggtggatcacttraggtcaggaattcaagactagcctggccaatatgcagaaactccatctctactaaaaacaaatattagccgggtgtggtggcatgtgcctgtagatccca

SEQ ID NO: 70449 - DNA, 201 bp, Homo sapiens
cacacagacagagcatgtcagacgccccgactcaatttgccaaacacaccctctatgccagtccggtgctgggagctgctgggaccctaaggagcccccarcctggggaagacatagccggacagacaggaaagcgggtttttcagaggagaggacgcagttttgccaggctagattccaagcagtggggccagggtgggc

SEQ ID NO: 70450 - DNA, 201 bp, Homo sapiens
ggacggcggtggcggctcccggccatcggagccgcctggcaaaaggcgcgctgctgcagcgctccaagaggtagggggcacggcgccggcgaaggctcggsggccagccgagcaaacaggagttgccagaagtgtgtcctggccgcgtggcgcggaccacggcgagcgtctgtctgtggcagcagtgggaaggggggagga

SEQ ID NO: 70451 - DNA, 201 bp, Homo sapiens
tttcagtagagatggtgtttcaccatgttggccaggctggtctcaaactcttgacctcatgatctgcccgcctcggcctcctaaagcgctgggattacagrcatgagccatcgcacccggccttgtatttttttattttgttttgttgttttaatttgcttttgttttagccattttgttttttcttttttttttttttga

SEQ ID NO: 70452 - DNA, 201 bp, Homo sapiens
agctggtccaggggctcctggccatatgtagtgtcctccatcaggctagaagcacttcatgccattgctgttaataacaacactgccaatagtttgtgttkgtttttgttattgtttttcagatgaagtttcactcgtgtcgcccaggctggaatgcaatggcactatctcagcccactgcaacctccgcctcctgggttc

SEQ ID NO: 70453 - DNA, 201 bp, Homo sapiens
acccagctaatttttaaattttgtatagagacggggtcttgctatgttgcccaggctggtcttgaactcctggcttcagaggatcctcccaccttggcctyccaaagcactggggttactggcgtgagccaccatgcctggccagcagtagtgtcaataataaggaatgttagttgaggggtgattccctcctgggccttg

SEQ ID NO: 70454 - DNA, 201 bp, Homo sapiens
tcccatccttctccagaacgggctgcgagtgtgatttaggctgggcaggtggcttagcgcggggccctgggcagccacctaccctgtccccttttcccccsacagctgccgcagcgggaaccgcaagagcttggtggtaggaacgccctccccgaccctctcccggcccctgtcgccattgtcggtcccaacgggtgagtg

SEQ ID NO: 70455 - DNA, 201 bp, Homo sapiens
atagtcctcggaatttctcggctgcctctgccctaaatttcccctttgcccggaggtgagtgattgccggctttgggagacagtgcgggcaccacgggcargggttgggcaggggcacgtgctcggtggctagacctggctcctcattcatttcattcaccttttcccctcccctggcccgtctggtggtggtctccccct

SEQ ID NO: 70456 - DNA, 201 bp, Homo sapiens
ttcctccctgcaggctgaggtcctggacatcctctggatcctcctgtcagtcatcttcgtcccagcccgagcggggtcccagcccatctctcctgaatacyatcagcctggacacaatgcccaagtttgccttctcatcagaggatgagggggtaggcccaggccctgcaggccccaagaggcccgtcttcattctagggg

SEQ ID NO: 70457 - DNA, 201 bp, Homo sapiens
ccaagaatctagggcgtgtgtcggccgccccctggctggatttcctgtgtgtctgggctcaggaggccacagcatccctcaggcttcagaaggagaaaccraggcaccaagtgtggcagacccttgtctggggttccccagcaagttgggcctcctgggtgtccgtccctgaccaggcatggggccccatctgttacccag

SEQ ID NO: 70458 - DNA, 201 bp, Homo sapiens
ggtggggggaactgatgggcagaggcctggagaccagaagtgaaggcagggagatgtatggttcaggcaggtaaagtactattaccaaagtactgccaggygagagagcgaacatgcacttaggagacaccagctgtatacagcactaattgctgccctgtcggggagaatcagaaggcagggtctcagcttggcgcgctg

SEQ ID NO: 70459 - DNA, 201 bp, Homo sapiens
gtataaccatcatttaatgaactatgtagtcagtacctcctgtttgctccagctctgtaaagaaacaattctgtgccggcactttgggaggccgaggcagrtgaactacctgagatcaggagttcaagaccagcctgaccaacacggcaaaaccccgtctctactaaaagtacactaaaaaaatatatatatatatacaca

SEQ ID NO: 70460 - DNA, 201 bp, Homo sapiens
cattcattcattcacttaacaagagctgattgagcacctgtcatgtgccagacgcttgcatttcatttatttattcatacaacaacattcattaagcaccyactgtgtgtatgctctgtgctgcgggctgagggcatggtcgcaaatgggcagctggccctgagcccctggggagtcctccgtttggtggggggtggtcaa

SEQ ID NO: 70461 - DNA, 201 bp, Homo sapiens
tgggcagctggccctgagcccctggggagtcctccgtttggtggggggtggtcaatgtgtgccccagaagctacagctcagaggttgaagctttgacaggrgacacagtggcagctggagtcacggggggggcttcctggaagaggtacctaaagagagagagcatgcagtggacttggtcagcctgtgtctctgttcttg

SEQ ID NO: 70462 - DNA, 201 bp, Homo sapiens
ccctggggagtcctccgtttggtggggggtggtcaatgtgtgccccagaagctacagctcagaggttgaagctttgacaggggacacagtggcagctggastcacggggggggcttcctggaagaggtacctaaagagagagagcatgcagtggacttggtcagcctgtgtctctgttcttggttattttcaggagatcct

SEQ ID NO: 70463 - DNA, 201 bp, Homo sapiens
cgtctctcccatcttccggctatggaaccaacacacccagctccaccctctcggtacccatagccccaccttggcaggtggacaggcagatgccgggttgkggggggacacatctttgtgtgtttttttcaaggtgttggatagttgtgcagtcagcaaacatactagttacttcctccatgcacgccccattctgggaaa

SEQ ID NO: 70464 - DNA, 201 bp, Homo sapiens
tcggtacccatagccccaccttggcaggtggacaggcagatgccgggttgtggggggacacatctttgtgtgtttttttcaaggtgttggatagttgtgcrgtcagcaaacatactagttacttcctccatgcacgccccattctgggaaatgcagggtcccctgagaagacccagccttggccccaaaatagtccctggt

SEQ ID NO: 70465 - DNA, 201 bp, Homo sapiens
tgggcagcgcctggcggctggaccagcccctgcacttctttccacattgctgtccctccatggaactctgtcttcctggctatgtcccctttgccagtctkttcatttctgtctttccttccccttccgttgaaagatgtcgttcctcctgcgccagccctcccacccgatcgccccattgccccatctcctctctcccca

SEQ ID NO: 70466 - DNA, 201 bp, Homo sapiens
tccctccatggaactctgtcttcctggctatgtcccctttgccagtctgttcatttctgtctttccttccccttccgttgaaagatgtcgttcctcctgcrccagccctcccacccgatcgccccattgccccatctcctctctccccaaccatgcctctcctgccccattctgcgtgtgtcactccagccccgccctctg

SEQ ID NO: 70467 - DNA, 201 bp, Homo sapiens
cggccaccttttttttttttttttttgagacggagtctcattctgtcacccaggctggagtacaatggtgtggtcttggctcactgcaacctccgcctccsgggttcaagggattctcctgcctcggcctaccgagtagctgggactacaggcgcctgccaccacatccagctaatttttgtattttaagtagagacgggg

SEQ ID NO: 70468 - DNA, 201 bp, Homo sapiens
ttcctggctatgtcccctttgccagtctgttcatttctgtctttccttccccttccgttgaaagatgtcgttcctcctgcgccagccctcccacccgatcrccccattgccccatctcctctctccccaaccatgcctctcctgccccattctgcgtgtgtcactccagccccgccctctgaccaggtcgccccgtctcgc

SEQ ID NO: 70469 - DNA, 201 bp, Homo sapiens
ttttgtaatcccggcattttgggaggccaaagtgggtggatcatctgaggtcaggagttcaagactagcctgggtaacatggcaaaaccctgtctcttctaaaaaaaaaaaaaaaagtcccagctactctggaggttgaggcaggagaatcgcttgaacctgggagacagaggttgcagcgagccgagattgtgtcattgc

SEQ ID NO: 70470 - DNA, 201 bp, Homo sapiens
acaggtgacagttcccatcgtgtagggctttgagaggaacacagggtgctattgggctagcgtgggcttccctaaggaggcagcgggagtggagacccagkgggtgagctgggaagggtgctccaggcagagggaacagcatgtgcagaggcctgcaggtggaaccaagccccgggtgaccagccctcctgtgcccctagg

SEQ ID NO: 70471 - DNA, 201 bp, Homo sapiens
aacaccacacctggctaatttttttttcttttttgagacggaatctctcattgttgccaggctagagtgcaatggcaccatctcagctcactgcaagctcygcctcccaggttcaagcgatcctcccgagtagctggggctacaggtgtgcaataccacgcccagctaatttttgtatttttagtagagacagggtttcac

SEQ ID NO: 70472 - DNA, 201 bp, Homo sapiens
taaggaggcagcgggagtggagacccagggggtgagctgggaagggtgctccaggcagagggaacagcatgtgcagaggcctgcaggtggaaccaagcccygggtgaccagccctcctgtgcccctaggagtttgaccctgaggaattttaccacctgctggaggcggctgagggccatgcgcgggagggccaaggcatta

SEQ ID NO: 70473 - DNA, 201 bp, Homo sapiens
ttctcctgcctcagcctcccaagtagctgggattacaggcacacaccaacactcccggctaatttttgtattttcagtaaagatggggtttcaccatgttrgctaggctggtctcgagctcccgacctcaagtgattctcccgccttggcctctcaaagtgctgggattacaggcatgaaccaccaagcctggcctaatgt

SEQ ID NO: 70474 - DNA, 201 bp, Homo sapiens
caggagaaaggatgttaccttctgatggccagcaggcagcctgggccttgaggggtggtgctgggttcctggccacagcactgacggtgaactcatggctytgatccccaccactctctaccagtcaagctcatcctcccgggaacgtctccaccagcttcccttccagccgacgccggacgagctgcacttcctgtccaa

SEQ ID NO: 70475 - DNA, 201 bp, Homo sapiens
aaggatgcacaggagttctccaggaactatcacaagaccttggaaagaatagaaagtagctgggtctggtgcccatatggagcactgagcctgaataagtrtgtgaggctgtaaagtcaccaggacctgtgtcaaaggcccagcccagaagatcccactgtcccagttttcccagccacctggttaatcattaagggaccg

SEQ ID NO: 70476 - DNA, 201 bp, Homo sapiens
ccgacctcaggtgatctgccggcttcggcctcccaaagtgctgggattacagttgtgagccactgcgcccggcaaatgaactcatttttaaaactctcacrcaagtacagtatatactgctgtttaggttttcctatggacttaaatatataaatgttttgctacatcatagtgtcttatgcaccagctgtatgaagtcgc

SEQ ID NO: 70477 - DNA, 201 bp, Homo sapiens
accctccccgctgagatagaacaaactggggaccttttgcaggaggtaaagcgaggaggatgcataggcattgggcataacctaaggggcgggcggggggygggggtgccccgggcctcatgactacatccgcccttctcccaggcggcgactgcgccacgctcctgaagaacatgggcccgctgcccgtggacatggccc

SEQ ID NO: 70478 - DNA, 201 bp, Homo sapiens
caggtggcacccacgaagtgaagcagcacccctttttcctggccctggactgggcagggcttctccgacacaaagccgagttcgtgccccagctcgaagcygaggatgataccagctactttgacagtaaggagggatccccctggagggggggcggggggtgctctgccatccctcagtccctgggggcagagggctgtg

SEQ ID NO: 70479 - DNA, 201 bp, Homo sapiens
ggctggagtgcagtggtgcgatttcgactcaccacaacctctgcctcccgggttcaagcgattctcctgcctcagcctcccaagtagctgggattacaggygcttaccactactgcccagctaatatttgtatttgtagtagagatggggtttcaccatgttggccaggctggtctcaaactcctgacctcaagtgagcca

SEQ ID NO: 70480 - DNA, 201 bp, Homo sapiens
ttggcctctcaaagtgctgggattacaggcgtgagccaccgcacccggccccacaactttttagggacacagctggtgttgatccccagatatctgctctrccgcccaagcctcccgtggtccttaaacacaccaggcactgtcccacctcagagcctttgccctggcagtgaccctatcctgagatgccctccccgtatt

SEQ ID NO: 70481 - DNA, 201 bp, Homo sapiens
cacctgaacccaggaggcagaggttgcagtgagccgagatcaccccactgcactccagcctgggtgacacagtgagaccatctcaaaaaaaaaaaaaaaargaaagaaagaaagaaagaaatacacaagcagccaggtgcagtggctctcgcctataatcccagcactttgggagcccgaagtgggagggtcacttgaggc

SEQ ID NO: 70482 - DNA, 201 bp, Homo sapiens
agcagatggtgcggggaccgaagggtccgggagtggtgccaggagagttctgtgtggtccagcttccccgggagcctttgcagggagctgccgattttgcytcacctctctctgccactttaaaaaaacatcttcaggccaggcacagtggctcatgcctgtaatccagcgttttgggaggccgagatgggaggactgctt

SEQ ID NO: 70483 - DNA, 201 bp, Homo sapiens
aaacatcttcaggccaggcacagtggctcatgcctgtaatccagcgttttgggaggccgagatgggaggactgcttgaggtcaggaggtcaagaccagccwgaccaacatggtgaaatcctatctctactaaaaatacaaaatcagccaagcgtggtggtgggcgcctgtaatcccagcttacttgggaggctgaggcaga

SEQ ID NO: 70484 - DNA, 201 bp, Homo sapiens
ctgtagtcccacctacttgagaggctgaggtgggaggattgcttgagtttaggagactgaagctgcagtgagccatgatggcaccactgcactccagcctrggtgacagagcaagagcctgtctctgaaataatcatacttggccgggtgcggtggctcacgcctgtaatcccagcactttgggaggccaaggcgggcaga

SEQ ID NO: 70485 - DNA, 201 bp, Homo sapiens
gtgagaggcacagaggcaacccctcaccatccctcccgcagagcggcaacaagatatccctgcggaccacagccctggagaacacctccatcaaggtgggycccgcccggaagaatgtggccaagggccgcatggcacgcaggagcaagaggagccgtcggcgggagacccaggatcggtgcgcggcagtgaccaccaggg

SEQ ID NO: 70486 - DNA, 201 bp, Homo sapiens
attacaggcatgagccactgcgcccggccaccttttttttttttttttttgagacggagtctcattctgtcacccaggctggagtacaatggtgtggtctyggctcactgcaacctccgcctccggggttcaagggattctcctgcctcggcctaccgagtagctgggactacaggcgcctgccaccacatccagctaatt

SEQ ID NO: 70487 - DNA, 201 bp, Homo sapiens
attcaagcagtcagagagaccttcgaggggtagattattctcctcccatcgtgacagcttggttttctgagcgcagagcagctgaagtcaggcctggggtracgccacacccccgcgacccttccccgcctctcccgggagaccttgccctcccagctgggtcatccggcagcccagcagcttccggccccctccaattgg

SEQ ID NO: 70488 - DNA, 201 bp, Homo sapiens
gccaaggcaggaggatcacttgaagccaggagtttgagaccagcttgggcaacatactgagatctcgtctctattaaaaaaacaattagccaggcatgatsgcacatgcctatagtcctagctacttgcggggctgaagtgggaagactgcttgagcccaggggtttgaggctgcagtgagctatggtcgcacaactgcac

SEQ ID NO: 70489 - DNA, 201 bp, Homo sapiens
gagcatggaatgaaagtctaagtgtaccaggtgtggtggctcatgactgtagtcccagctactcaaggaggctgaggcagaaggatctctctctctctctyttttttttttttttgagaaagaatcatgctctgttacccaggctggagtccagtggcgcaatctcggctcactgcaacctccacctcccgggttcaagta

SEQ ID NO: 70490 - DNA, 201 bp, Homo sapiens
tagtacagaaagggttcctccctgttggtcaggctggtctcaaactcctgatctcaggtgatctacccacctcggcctcccaaagtactgggattacaggygtgagtcaccatgcccgacctaatttttgtgtttttagtagagacgggtttcaccatgtttaccaggatggtctcaaactcctgacctcaggtgatccgc

SEQ ID NO: 70491 - DNA, 201 bp, Homo sapiens
tggccaaggaccccctggagggtaagccgggatgggaagaggaaaccaaggctgggaaaggccggatggaggccaggcacggtggctcacacctttaatascagcactttgggaagctaaggcgggcagatcacttgaggccaggagttcgagaccagtctggccaacatggtggaaacccccccccctactaaaaataca

SEQ ID NO: 70492 - DNA, 201 bp, Homo sapiens
ggggcccgttgggtgggggggcgggacagcattaggaaaaatagctaacgcatgccgggcttaatacctgatgagttgataggtacagcaaaccaccatgrccacatgtttacctatgtaacctgcacatcctgcacatgtaccctggaacttaaaataaaaattataattaaaaaaagaattgagtagctgcaccactag

SEQ ID NO: 70493 - DNA, 201 bp, Homo sapiens
agcattaggaaaaatagctaacgcatgccgggcttaatacctgatgagttgataggtacagcaaaccaccatggccacatgtttacctatgtaacctgcamatcctgcacatgtaccctggaacttaaaataaaaattataattaaaaaaagaattgagtagctgcaccactagaaagatggcagtagcaagacagaagaa

SEQ ID NO: 70494 - DNA, 201 bp, Homo sapiens
cctatgtaacctgcacatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacga

SEQ ID NO: 70495 - DNA, 201 bp, Homo sapiens
aacattgatgttgggtcaatcatgttctcaatgtatttaaccatgtgtttttaaattttttaatttagttatcaaattgagaatctgatggtatggcattwatcaccttgaggaagaacctttatcgtttatctgattttcagatgcatagagctctggctgctttaaaaaataaacctctaaatcatgttcacaaggtag

SEQ ID NO: 70496 - DNA, 201 bp, Homo sapiens
ggggtgctcgccccgcgggtccctttcattcctaggaaaacgcgccgcggggcctcccgtctgtctgtcttgcacacacgtgttgccaaatccccccgcascgtctttagatctggactggccgccccaccttctcccttcattgatctatgttttgctttttcttttcctaccttgtttccattgacaaagtagaccctt

SEQ ID NO: 70497 - DNA, 201 bp, Homo sapiens
tgttattgttcaatgtcagccactcttctaactctaggatgcagagactttgcccctctggtgtttatatgttaaccatccttttttttttttttttttttccagatactcgtttgtagtttcataaacattgatgttgggtcaatcatgttctcaatgtatttaaccatgtgtttttaaattttttaatttagttatcaa

SEQ ID NO: 70498 - DNA, 201 bp, Homo sapiens
gtggctttatttccccatgggtgcagtttccttttaagttcctttacttctgatctgtctcaataacctgaaaaagcagaatttcatttacttggagtcakttgccaccagataggcttttctttgataaatggaccccatttttgtgttcttgttcttgaaggaacaatttcctgctgtttaagatttcttaggaggttt

SEQ ID NO: 70499 - DNA, 201 bp, Homo sapiens
tggattgaaggatctctgccacctatcataaggggaaagagaaagcatgcatggttcttgtcataccccagataacttcagaacccattctgtggtttagygttattgagctttcttaatttaaggctgacttgattgatcataaagccaattgaattaaaattctcaccattgtttggttgtggtcattactttgcagcc

SEQ ID NO: 70500 - DNA, 201 bp, Homo sapiens
cagagactttgcccctctggtgtttatatgttaaccatccttttttttttttttttttttccagatactcgtttgtagtttcataaacattgatgttgggycaatcatgttctcaatgtatttaaccatgtgtttttaaattttttaatttagttatcaaattgagaatctgatggtatggcattaatcaccttgaggaag

SEQ ID NO: 70501 - DNA, 201 bp, Homo sapiens
ttgccaaacagaaaaattttcacctcgtcagatttctgcgttaatggaaccatttgggaaactcaattatttgccaccaaatgcctctgctttatttagamagctggaaaacgtgctattcactcatttcaattattttccacccaaatcattattgaaacttcttcattcatgttcacttaatgaatgccatccagtcaa

SEQ ID NO: 70502 - DNA, 201 bp, Homo sapiens
gctgctttaaaaaataaacctctaaatcatgttcacaaggtagtcaaggagcgtctgtgcccttggttgtgttcacgacaacctgagcctttcggggtcarattccatcatgcccattgtaaaaagtttcattcgaaaaatggaaatgaccttcatccactcggtggaccagtgttctctcaagtatctgactgcgacagg

SEQ ID NO: 70503 - DNA, 201 bp, Homo sapiens
actgcagtagagaactgattctttcaaaacccatcctcaatgcagtggcagaaacttttgtttgccaaacagaaaaattttcacctcgtcagatttctgcsttaatggaaccatttgggaaactcaattatttgccaccaaatgcctctgctttatttagaaagctggaaaacgtgctattcactcatttcaattattttc

SEQ ID NO: 70504 - DNA, 201 bp, Homo sapiens
aatagaatacttctgtctggagtgtgtaaattgatgttgaatgttcatgatgttctctcatacatacctcaattcagacgtaactatgactgggatgcttwctgtttcaggtaaagaatctcatttggacacattgagtcgggcacaactgacccaacttttcttagcctcagtcctggaatgccctttctataaggtaaa

SEQ ID NO: 70505 - DNA, 201 bp, Homo sapiens
gactttgcccctctggtgtttatatgttaaccatccttttttttttttttttttttccagatactcgtttgtagtttcataaacattgatgttgggtcaaycatgttctcaatgtatttaaccatgtgtttttaaattttttaatttagttatcaaattgagaatctgatggtatggcattaatcaccttgaggaagaacc

SEQ ID NO: 70506 - DNA, 201 bp, Homo sapiens
tttccaacctgagtcctaaattgattagccaaatgctcactgccctggtggttcttgatcaaagtcaagcatttcctctgattataaaattgggcaaataygtcgtgaggcatgtcccacatttcactaacgaggagcttaggagagtcttggaggcgttcatatattttgggcaccatgacacattttttacaaaagccc

SEQ ID NO: 70507 - DNA, 201 bp, Homo sapiens
aactcaaacaatggaagaacttgcatttttatggaactcagtattaaaagaaaaatataatgtgaattagccactttgcagaatatgttctagactggtgrtctgaaagcatctgtagttttccttatactatgtatacatttattgtggtaaaatttaaaattaattttaatttaatactagtgtcatagatactttttg

SEQ ID NO: 70508 - DNA, 201 bp, Homo sapiens
tgaactattctgtggaaagttcctagttatataattattagtttgtgagatgcttctgattggttgagcttaagttctgtttttctgtagtagaagcttckacaagaaatagcccaagttaaattttgcttaacatttgcactttaagcaaagttaaggttattttcaaggcccaactggcttggtctgctcagggatttt

SEQ ID NO: 70509 - DNA, 201 bp, Homo sapiens
tatttttaagccaagccagaaatttcacttttatctaatagagtttagtttatctagagttcgctcttcccataaagacctataaagatttatcctattayctatcacattccttatgtagaatcagaaatagcacaccagactatgacattctctctctgcttctctctacttgactctgaatcatagtttagagtatct

SEQ ID NO: 70510 - DNA, 201 bp, Homo sapiens
atactagagcctttttggtttttttcatatataaactagattcccaaaaatgtgattagtggattaatttttgatggatactggcagattttttttccctwatagttacagatgtcacatttccccagcaatgaatgaaggtggccatgtctcctccacttctattgcagtgtgttagtagtctctttaatttgtgttact

SEQ ID NO: 70511 - DNA, 201 bp, Homo sapiens
aatttctccttgatttaataaataaaaatgaacaagataatccattaaaataaggagcttcaccaacacttaatatttaagaccttttaaatatttcactrtagataatgtaagaaggtcttatgtgagggctcagcagtgcgtgagaatgagagctgccctaattctctaagctgtcagtactaggcagcactgtggttt

SEQ ID NO: 70512 - DNA, 201 bp, Homo sapiens
tatagatatgtgaagattgggctgactaaccttttaggagcaagattatattttgctccaaaagtgttgacaccctattgttatacaataggtaagtagtrtaaggagttttgttgttttaaacctaagcatcctgttcgattttggagatatatgggacttagaagcaatagaagttctctggaaatgcaaaatggaatg

SEQ ID NO: 70513 - DNA, 201 bp, Homo sapiens
ggagcttcaccaacacttaatatttaagaccttttaaatatttcactgtagataatgtaagaaggtcttatgtgagggctcagcagtgcgtgagaatgagmgctgccctaattctctaagctgtcagtactaggcagcactgtggtttcatatctgctgacttttttctccatcttgcacatccccagctgaatattccta

SEQ ID NO: 70514 - DNA, 201 bp, Homo sapiens
ggtttaagtctcaaatattagccacgtagtagcagaatatcctgggcagaatatttaacctttttctgcttgcttcttcctctgtaaaatgatagtaataytgacctcaaagacttacttaaggtctaaataaaatagtacctggaacgtaggaaatgctcactaattgttagctactactataacctaggcttgtactgt

SEQ ID NO: 70515 - DNA, 201 bp, Homo sapiens
atcaagacgtgaattggtggaatatttacaaagaaaactgttttctcaaaacactgttcattggttgcaagaatgaatactgacttcagaactcaaacaayggaagaacttgcatttttatggaactcagtattaaaagaaaaatataatgtgaattagccactttgcagaatatgttctagactggtgatctgaaagcat

SEQ ID NO: 70516 - DNA, 201 bp, Homo sapiens
gtaagtgctcagtagccacatgtggctcatggctgccaaattggacagcaccattataaagatttccacatcacagaaatttctcctggacagcactgacragagactccaagtcctccgtccttacagttcttctaacttgatgagcagaagaaagccttctcgtaaaggacagcagttcataggcttcagatggtcact

SEQ ID NO: 70517 - DNA, 201 bp, Homo sapiens
tctgctttatttagaaagctggaaaacgtgctattcactcatttcaattattttccacccaaatcattattgaaacttcttcattcatgttcacttaatgratgccatccagtcaactttctggcaaaaatattcaagcctcttttccttcaacggctgcaaggtgagttggttataaattctgacagttggaaaaaagta

SEQ ID NO: 70518 - DNA, 201 bp, Homo sapiens
gatttgtattgccatccacagctaatgaagatatccataaaaggtacaggaaaatgttgtgtttttcacattacaagactcgttgaggctaataagcagcrgtatctttttctcaagaaggtgaaaaaaatagatatgattctggaaattaaaatactacatttcagaataccatgttgggaaattccttgtaatatttta

SEQ ID NO: 70519 - DNA, 201 bp, Homo sapiens
gatttctatccaaatgcaatttcttccttcaaccaacatttaagggccacccttaagagctacattgcctgagtttgaaccctagctctgccacttaaccmcctgcataaactgggcaaagtaactttgtgcttcaacttcttcctcgtgtaaaatgatagtaaaagtactgaatctgtgtaagttaatagaatacctaca

SEQ ID NO: 70520 - DNA, 201 bp, Homo sapiens
agctaatgaagatatccataaaaggtacaggaaaatgttgtgtttttcacattacaagactcgttgaggctaataagcagcagtatctttttctcaagaargtgaaaaaaatagatatgattctggaaattaaaatactacatttcagaataccatgttgggaaattccttgtaatattttataaacattaatattaataa

SEQ ID NO: 70521 - DNA, 201 bp, Homo sapiens
ataccatgttgggaaattccttgtaatattttataaacattaatattaataagatcaaattcatgattcatttgaaaataatattggcacatagtaatagmcaaatcccaaataaactttggcaactaaaatatataataaatattttggattatttaaaaaattaagtatttttctccttttttatttttcaggatagca

SEQ ID NO: 70522 - DNA, 201 bp, Homo sapiens
caggatgaagaagctggttgggatatttgccttccaggagcttacattccgctgtggggaagcgtgtaagaaacaaacaaagtaaccaatagccagaggamcctcagattttgaaggatcttgaccagttttacttttctacctttacagatcccctatcatgagattgggatgctaaaatcaagacgtgaattggtggaa

SEQ ID NO: 70523 - DNA, 201 bp, Homo sapiens
ggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctc

SEQ ID NO: 70524 - DNA, 201 bp, Homo sapiens
gggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccac

SEQ ID NO: 70525 - DNA, 201 bp, Homo sapiens
tagctgttcatggaagggtaagaggtctgagacaggcactgaagagggccagttgctgggacagtgtccattcctacgctgccagacgtgagggatggctragtccttttggactctattgctgtgggtgttctgggctgtgggaatcagtaggtctgatcccaaatggcagtttctgtgccgtcccacacggtctgctgg

SEQ ID NO: 70526 - DNA, 201 bp, Homo sapiens
agtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcacttttta

SEQ ID NO: 70527 - DNA, 201 bp, Homo sapiens
gaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagagagttatatgcagcctcttttgcacctcgttg

SEQ ID NO: 70528 - DNA, 201 bp, Homo sapiens
taatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctt

SEQ ID NO: 70529 - DNA, 201 bp, Homo sapiens
cctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgttt

SEQ ID NO: 70530 - DNA, 201 bp, Homo sapiens
cctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgat

SEQ ID NO: 70531 - DNA, 201 bp, Homo sapiens
gggtccacatcgaagaattcagtccttgtggatgaactgtaaacagcacccttcctctaagatgccgaagatcatagtttgtggtttttttctttcaggcrgtggaagcagggcagagccgaagcagcccgctcctcaagaggccggtgcggacccaggcggtgctggaccagtcagatgtgtacacccatgtcctgtcag

SEQ ID NO: 70532 - DNA, 201 bp, Homo sapiens
atctaagtagagaaagtgttttccgctcatatcctgggtccacatcgaagaattcagtccttgtggatgaactgtaaacagcacccttcctctaagatgcygaagatcatagtttgtggtttttttctttcaggcggtggaagcagggcagagccgaagcagcccgctcctcaagaggccggtgcggacccaggcggtgct

SEQ ID NO: 70533 - DNA, 201 bp, Homo sapiens
aaaaaattgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcct

SEQ ID NO: 70534 - DNA, 201 bp, Homo sapiens
cctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcag

SEQ ID NO: 70535 - DNA, 201 bp, Homo sapiens
taggtcactttgagtgagctcatcaaaggaagcatgtcataaatgcaggaaatacttgtgagaggagataaaaatattaaaagagagttgtgatgttaatsacaaattccttctcaagtaagagctagcctgtagggaggaaatgcaaacacaggcttttaaactgatttaaacagcaagatgggatggaatgaaagcaac

SEQ ID NO: 70536 - DNA, 201 bp, Homo sapiens
aaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaacc

SEQ ID NO: 70537 - DNA, 201 bp, Homo sapiens
gaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaa

SEQ ID NO: 70538 - DNA, 201 bp, Homo sapiens
acttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccaca

SEQ ID NO: 70539 - DNA, 201 bp, Homo sapiens
cctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagtt

SEQ ID NO: 70540 - DNA, 201 bp, Homo sapiens
ttagctgttcatggaagggtaagaggtctgagacaggcactgaagagggccagttgctgggacagtgtccattcctacgctgccagacgtgagggatggcygagtccttttggactctattgctgtgggtgttctgggctgtgggaatcagtaggtctgatcccaaatggcagtttctgtgccgtcccacacggtctgctg

SEQ ID NO: 70541 - DNA, 201 bp, Homo sapiens
ccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccag

SEQ ID NO: 70542 - DNA, 201 bp, Homo sapiens
aagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattc

SEQ ID NO: 70543 - DNA, 201 bp, Homo sapiens
actctgtatcctttactaaggtgtggcaccgtgcacaacagggcaagtggtcaccctcagagagtggtcctgaagtcctcctccgggcagctgtgaataamactccgagagccaccccgcaggcagcttccctgactgtccaggggcctcgcgtttagcgtggactcagtacatggtgggcaggggcgagtgctagcggaa

SEQ ID NO: 70544 - DNA, 201 bp, Homo sapiens
cagcccgctcctcaagaggccggtgcggacccaggcggtgctggaccagtcagatgtgtacacccatgtcctgtcagccttcgtggaaaagaaggtgggcygcagctttccgcctcttctggactgagaatgctcaaaacaaggaagttgctgaaaacgaggagacttcatgtgattagagtcacttgaagtgattagaat

SEQ ID NO: 70545 - DNA, 201 bp, Homo sapiens
aggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggt

SEQ ID NO: 70546 - DNA, 201 bp, Homo sapiens
aagcagggcagagccgaagcagcccgctcctcaagaggccggtgcggacccaggcggtgctggaccagtcagatgtgtacacccatgtcctgtcagccttygtggaaaagaaggtgggccgcagctttccgcctcttctggactgagaatgctcaaaacaaggaagttgctgaaaacgaggagacttcatgtgattagagt

SEQ ID NO: 70547 - DNA, 201 bp, Homo sapiens
tcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatc

SEQ ID NO: 70548 - DNA, 201 bp, Homo sapiens
gcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgt

SEQ ID NO: 70549 - DNA, 201 bp, Homo sapiens
aggggaatgttgtatataaacttttgcagctagctttttttttttttgtccaaagtgtatcttggacatctttctatattttattctgactgggtagtatyccactgtatggatggactgcagtttaaaaattttcttgttattggacattggctggttttccatttttttgtgattacaaataacccttcagtaacatgc

SEQ ID NO: 70550 - DNA, 201 bp, Homo sapiens
attagaataaggtcgctgagatttgccgcctgccatagggcaaggtggcagtagtgggggatagtggaggagtagtaaattcagggtccctgcatcccackagctggcggctgcatctcacttcataccttcactgtttttgtttttcccatctgtgtttgatcttgcctgtagatccttggtctactgttatagatgaga

SEQ ID NO: 70551 - DNA, 201 bp, Homo sapiens
gctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagtttt

SEQ ID NO: 70552 - DNA, 201 bp, Homo sapiens
ttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaa

SEQ ID NO: 70553 - DNA, 201 bp, Homo sapiens
ttttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataacactccgagagccacccc

SEQ ID NO: 70554 - DNA, 201 bp, Homo sapiens
gcataattgttgacgggtggttctggagcgatgtgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatg

SEQ ID NO: 70555 - DNA, 201 bp, Homo sapiens
atggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgag

SEQ ID NO: 70556 - DNA, 201 bp, Homo sapiens
cataaatgcaggaaatacttgtgagaggagataaaaatattaaaagagagttgtgatgttaatgacaaattccttctcaagtaagagctagcctgtagggwggaaatgcaaacacaggcttttaaactgatttaaacagcaagatgggatggaatgaaagcaactgggcaaaccatgattgattttggcctcagtcttgtc

SEQ ID NO: 70557 - DNA, 201 bp, Homo sapiens
ttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctga

SEQ ID NO: 70558 - DNA, 201 bp, Homo sapiens
caaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttc

SEQ ID NO: 70559 - DNA, 201 bp, Homo sapiens
gtcaccctcagagagtggtcctgaagtcctcctccgggcagctgtgaataacactccgagagccaccccgcaggcagcttccctgactgtccaggggcctygcgtttagcgtggactcagtacatggtgggcaggggcgagtgctagcggaaactgggtttgctttttgttttcatcttttcctggtttagaatttcctat

SEQ ID NO: 70560 - DNA, 201 bp, Homo sapiens
gcaagactccgtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaa

SEQ ID NO: 70561 - DNA, 201 bp, Homo sapiens
aatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaacccc

SEQ ID NO: 70562 - DNA, 201 bp, Homo sapiens
gacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaac

SEQ ID NO: 70563 - DNA, 201 bp, Homo sapiens
ctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccat

SEQ ID NO: 70564 - DNA, 201 bp, Homo sapiens
tggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaatt

SEQ ID NO: 70565 - DNA, 201 bp, Homo sapiens
tcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttt

SEQ ID NO: 70566 - DNA, 201 bp, Homo sapiens
tgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttgg

SEQ ID NO: 70567 - DNA, 201 bp, Homo sapiens
cattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttaga

SEQ ID NO: 70568 - DNA, 201 bp, Homo sapiens
ggcagcttccctgactgtccaggggcctcgcgtttagcgtggactcagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcag

SEQ ID NO: 70569 - DNA, 201 bp, Homo sapiens
agcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacag

SEQ ID NO: 70570 - DNA, 201 bp, Homo sapiens
tgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttca

SEQ ID NO: 70571 - DNA, 201 bp, Homo sapiens
gcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcc

SEQ ID NO: 70572 - DNA, 201 bp, Homo sapiens
ttcagtccttgtggatgaactgtaaacagcacccttcctctaagatgccgaagatcatagtttgtggtttttttctttcaggcggtggaagcagggcagarccgaagcagcccgctcctcaagaggccggtgcggacccaggcggtgctggaccagtcagatgtgtacacccatgtcctgtcagccttcgtggaaaagaag

SEQ ID NO: 70573 - DNA, 201 bp, Homo sapiens
gtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactg

SEQ ID NO: 70574 - DNA, 201 bp, Homo sapiens
gggtattttctaagtaattatgatgcaaaattgtttcctatatattagaataaggtcgctgagatttgccgcctgccatagggcaaggtggcagtagtggkggatagtggaggagtagtaaattcagggtccctgcatcccacgagctggcggctgcatctcacttcataccttcactgtttttgtttttcccatctgtgt

SEQ ID NO: 70575 - DNA, 201 bp, Homo sapiens
cattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaat

SEQ ID NO: 70576 - DNA, 201 bp, Homo sapiens
gaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcaatatgtgag

SEQ ID NO: 70577 - DNA, 201 bp, Homo sapiens
ctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgccca

SEQ ID NO: 70578 - DNA, 201 bp, Homo sapiens
tggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaag

SEQ ID NO: 70579 - DNA, 201 bp, Homo sapiens
ttagtctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctat

SEQ ID NO: 70580 - DNA, 201 bp, Homo sapiens
aacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccttgactacaattgaataaacatttcgtaatgacattaaa

SEQ ID NO: 70581 - DNA, 201 bp, Homo sapiens
tctctcccggctctcttttgaaggagattggagtgcagaattggctagtctgaggtttcagtgtgcaagacgtagtcagatggctcacatttggaaccctrgtagtaatgttttattctttgtccgatggcattgggcgggttgacccagcctgcagtcaggatttccttgtaccgttcacccgggagttcagaatcgcac

SEQ ID NO: 70582 - DNA, 201 bp, Homo sapiens
ttttgtccaaagtgtatcttggacatctttctatattttattctgactgggtagtattccactgtatggatggactgcagtttaaaaattttcttgttatkggacattggctggttttccatttttttgtgattacaaataacccttcagtaacatgcttgtacacacttctttatattagagggagagttgcagtatagg

SEQ ID NO: 70583 - DNA, 201 bp, Homo sapiens
catgctttctttttcttggtgagattttcctggattgtcagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgca

SEQ ID NO: 70584 - DNA, 201 bp, Homo sapiens
ctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattcttt

SEQ ID NO: 70585 - DNA, 201 bp, Homo sapiens
ttttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttt

SEQ ID NO: 70586 - DNA, 201 bp, Homo sapiens
ccctgggataacacatcctggcgccttagaagaaaaggaatgtgtggagcagaaataagaatgcaaacaaagaccgttatgagcttcttttcaccaaagargcatattcctggaaagttgtgtgcacaatgaattgaggtgaatcttttttgtttttgttttttgtttgtttgttttttgagacagagtctcactctgttg

SEQ ID NO: 70587 - DNA, 201 bp, Homo sapiens
ctgccctcatgctcacagataggaaactgagatgggggaaaggaagcaaagtgatcacccaaggtcaccagcaagttggcggccgagccacttttccatcytctcacccagcttcttccgtgtcccccgcctccccaggtaccggtccgtagtggatctcatgaagtcctggtctgaggagaagtggcattacttgtttcc

SEQ ID NO: 70588 - DNA, 201 bp, Homo sapiens
tgcacaaggcagacctgtgactcctccatccagctatgcccctgctgcccagcaccgtgggcctggcaggcctgctcttctgggctggccaggcagtgaaygccttgataatgcctaatgctaccccagccccggcccagcccgagagcacggctatgcggctcctgagtggcctggaggtgcccaggtaccgccggaagc

SEQ ID NO: 70589 - DNA, 201 bp, Homo sapiens
tcctgagtggcctggaggtgcccaggtaccgccggaagcgccacatctctgtgagagacatgaatgccttactggattatcacaaccacatccgggccagygtgtacccacctgccgccaacatggaatacatggtgagtccccgtacctgccccccaccccccgcagtgtcccttccggcaaacgcagccggactcatct

SEQ ID NO: 70590 - DNA, 201 bp, Homo sapiens
ccagcccgagagcacggctatgcggctcctgagtggcctggaggtgcccaggtaccgccggaagcgccacatctctgtgagagacatgaatgccttactgrattatcacaaccacatccgggccagtgtgtacccacctgccgccaacatggaatacatggtgagtccccgtacctgccccccaccccccgcagtgtccct

SEQ ID NO: 70591 - DNA, 201 bp, Homo sapiens
cttccaggcagccggctctgattgcacaaggcagacctgtgactcctccatccagctatgcccctgctgcccagcaccgtgggcctggcaggcctgctctkctgggctggccaggcagtgaacgccttgataatgcctaatgctaccccagccccggcccagcccgagagcacggctatgcggctcctgagtggcctggag

SEQ ID NO: 70592 - DNA, 201 bp, Homo sapiens
agagggggtttctccatgttggccaggatggtctcgaactcctgacctcaagtgatctgcctgcctcagcctcccaaaagtgctgagattacaggcgtgarccactgtgcccaagcggatatcttacatattaaaattatgcatattttcacgatttaaaaaagcttttgacttaaccattttcaatgttaaaataaacac

SEQ ID NO: 70593 - DNA, 201 bp, Homo sapiens
tttccagacttgtggatttcacaggcctataaaattgcaaaaagaaatctgtgagactgccacacaattgtcagatttttattttgccaaataaggatgtyagaaaaacaactaccttcccatcctcgccattctgccatcaccccggggagagtgggaaagaattaaggccagtcccttcaagtgagctcagtggaaatt

SEQ ID NO: 70594 - DNA, 201 bp, Homo sapiens
gccccttccttcacgaaggtgacattttagtgggaataagagaaaacaagcatgaacaacaagatattaatgtacataagataacgtgaggaggcaatacrgtgttgggaggggcgggaataagagccgggatggcaggcagctagagtgcaggggagtcattgacttgttcattcattcgttagcacctagaatgccctc

SEQ ID NO: 70595 - DNA, 201 bp, Homo sapiens
cgctaattttttgtagagacggtgtctcactatgttgcccaggctggtcttgaactcctaggctcaagcagtcctccttccaaggtctcccaaagtgctgsgattacaggcgtgagccaccctacccagcccaataatccttttcctttacccaagtttgagaatcactgggaaatagacaggattgacacaggtggaaag

SEQ ID NO: 70596 - DNA, 201 bp, Homo sapiens
ccactgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccg

SEQ ID NO: 70597 - DNA, 201 bp, Homo sapiens
agcaccagcctctgagagccgtgaatggtcactcagagccctacagagcagacatcgggtgattcagtcctgcctccatttcactttccctctcccccgcygctgaactcttcctgccagactccacccctacccatggccaccatttgagaggctcacagagagaaagaaagcagtgttagacacgaagctgtgctgtcg

SEQ ID NO: 70598 - DNA, 201 bp, Homo sapiens
tccgtctcaaacaacaacaacaacaaaaacaaaacaagaacaaattctaagtaaacatgatatttagaatttctttttttcttttttcttttttttttggsgggggacgaggtcttgctctgtcgcccaggctggagtgcaatagccagatcatagctcactgcagcctccaactcctgggttcaagcaatcctcccgcct

SEQ ID NO: 70599 - DNA, 201 bp, Homo sapiens
cctgtgaggcagggccactgccctcatgctcacagataggaaactgagatgggggaaaggaagcaaagtgatcacccaaggtcaccagcaagttggcggcygagccacttttccatcctctcacccagcttcttccgtgtcccccgcctccccaggtaccggtccgtagtggatctcatgaagtcctggtctgaggagaag

SEQ ID NO: 70600 - DNA, 201 bp, Homo sapiens
catgcctgtgaggcagggccactgccctcatgctcacagataggaaactgagatgggggaaaggaagcaaagtgatcacccaaggtcaccagcaagttggyggccgagccacttttccatcctctcacccagcttcttccgtgtcccccgcctccccaggtaccggtccgtagtggatctcatgaagtcctggtctgagga

SEQ ID NO: 70601 - DNA, 201 bp, Homo sapiens
agtcttctactttgtcacgtgggtttgttgcagggttccagggagatggggtagaaacggcaccaggtaaatgtgcatctctggacacagttgtgacgatrgtggcaattcccctggggaatttcattgcctttctttccccaggtctgggacaagcggctggccagggctgccgaagcctgggccacccagtgcatctgg

SEQ ID NO: 70602 - DNA, 201 bp, Homo sapiens
ggcaagtcttgtttggtttgagaacaaacaagtgcacagattgtggtggaaagtgaggagggattggaagactaagaaaataggataagggggccgggcayggtggcttacacctgtaatcccagcactttgggaggctgaggtgggcagatcacttcaggtcagtagttcaagaccagtctggacagcatggtgaaaccc

SEQ ID NO: 70603 - DNA, 201 bp, Homo sapiens
tgagcctcagtcttctactttgtcacgtgggtttgttgcagggttccagggagatggggtagaaacggcaccaggtaaatgtgcatctctggacacagttstgacgatggtggcaattcccctggggaatttcattgcctttctttccccaggtctgggacaagcggctggccagggctgccgaagcctgggccacccagt

SEQ ID NO: 70604 - DNA, 201 bp, Homo sapiens
gtcaaatatgtgtaatagaaaaagccctcagaggccgggtgcggtggctcatgcttgtaatcccagcactttgggaggcagaagcgagcggatcacctaasgtcaggagttcgagaccagcctggccaacatagtgaaacctcatctgtactaaaaatacaaaaattagccaggcgtatgcaggtgcatacctgcagtccc

SEQ ID NO: 70605 - DNA, 201 bp, Homo sapiens
acgttccagattctcatagaaaaacaagaacaggccaggagcagtgtcttacacctgcaatcccagcactttggggggctgaggcgagtgaatcacctgargttaggagtttgagaccagcctggccaacatggcaaaacctcgtgtctaccaaaaataccaaaattagctgggcatggtggcgcgtgcctgtaatcccag

SEQ ID NO: 70606 - DNA, 201 bp, Homo sapiens
gaggctgaggtgggagaatcacttgagtcctggagttggagaacagcctggaaagcctggcgataccccatctctatttagaaacaaacaaacaaacaaayaaaaaacctggcacctcggttttgtaactctcaggctttgtcaaacccaaatgactttgtccatccaatgaaaggaattccactgggtgcggcggctcac

SEQ ID NO: 70607 - DNA, 201 bp, Homo sapiens; identical to SEQ ID NO: 56116

SEQ ID NO: 70608 - DNA, 201 bp, Homo sapiens
gctcctcctgtccccccagttatcaaggcagctgcaatagcaacatgtgcttcaaggggctgaaatccaacaagttcacgtggttctgaattttctctggrctttggtgcgcctccagctgggcctgaccctccatgtcctgccctcaaaaaactgggtggagaaataattgtttctttaaaggatatgagttagaatcac

SEQ ID NO: 70609 - DNA, 201 bp, Homo sapiens
tgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgtttt

SEQ ID NO: 70610 - DNA, 201 bp, Homo sapiens
ctgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgttt

SEQ ID NO: 70611 - DNA, 201 bp, Homo sapiens
actgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgtt

SEQ ID NO: 70612 - DNA, 201 bp, Homo sapiens
cggctggccagggctgccgaagcctgggccacccagtgcatctgggcacatgggccttcacagctgatgagatacgtgggccagaacctctccatccattmtggccagtgagtgaccctctgcccttccttcactcagtcattcaacaaatactcattgaacacttactctgtaccaggtgctgcacttgacactgggata

SEQ ID NO: 70613 - DNA, 201 bp, Homo sapiens
cactgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgt

SEQ ID NO: 70614 - DNA, 201 bp, Homo sapiens
tcagtctcccaaagtgctgggactacaggcacgagccaccaagcccagcccctttaaggtaaatgctacctgctcacagaatttaaggattaaaatataaygtgaggccaggtgtggtggctcacgcctgtaatcccagcactctgagaggccgaggcaagtggatcacctgaggtcaggaggtcgagaccagcctggcca

SEQ ID NO: 70615 - DNA, 201 bp, Homo sapiens
agcccctttaaggtaaatgctacctgctcacagaatttaaggattaaaatataatgtgaggccaggtgtggtggctcacgcctgtaatcccagcactctgrgaggccgaggcaagtggatcacctgaggtcaggaggtcgagaccagcctggccaacatagtgaaatcccatctctactaaaagcacaaaaattagtcggg

SEQ ID NO: 70616 - DNA, 201 bp, Homo sapiens
acaaccccagggagcctgggtcccactgagcccttctcatagccccctctgtctctgtccttcaccagatggtgtgggcatcctccaatcggctgggctgygccatccacacctgtagtagcatcagtgtctggggcaacacctggcatcgggcggcatacctggtctgcaactatgccattaagtaagtgcctgcaccaa

SEQ ID NO: 70617 - DNA, 201 bp, Homo sapiens
gtggatctcatgaagtcctggtctgaggagaagtggcattacttgtttccggccccaagggactgtaacccacactgcccctggcgctgcgatggccccayctgctcccattatacccaggtactcctccgtcagggctgagggcccctgggataacacatcctggcgccttagaagaaaaggaatgtgtggagcagaaat

SEQ ID NO: 70618 - DNA, 201 bp, Homo sapiens
ctactttgtcacgtgggtttgttgcagggttccagggagatggggtagaaacggcaccaggtaaatgtgcatctctggacacagttgtgacgatggtggcrattcccctggggaatttcattgcctttctttccccaggtctgggacaagcggctggccagggctgccgaagcctgggccacccagtgcatctgggcacat

SEQ ID NO: 70619 - DNA, 201 bp, Homo sapiens
cgctttcctccgcaagcggatgaacaccaactcttaccgaggctcctaccacttccgggcccccagccgcatcttctggcggaccgtgcgaggtatgctgmcccacaagaccaagcgaggccaggccgctctggaccgcctcaaggtgtttgatggcatcccaccgccctacgacaagaaaaagcggatggtggttcctgt

SEQ ID NO: 70620 - DNA, 201 bp, Homo sapiens
caggtcctggtgcttgatggtcgaggccatctcctgggccgcctggcggccatcgtggtaaacaggtactgctgggccggaaggtggtggtcgtacgctgygaaggcatcaacatttctggcaatttctacagaaacaagttgaagtacctcgctttcctccgcaagcggatgaacaccaactcttaccgaggctcctacc

SEQ ID NO: 70621 - DNA, 201 bp, Homo sapiens
tccgggcccccagccgcatcttctggcggaccgtgcgaggtatgctgccccacaagaccaagcgaggccaggccgctctggaccgcctcaaggtgtttgayggcatcccaccgccctacgacaagaaaaagcggatggtggttcctgttgccctcaaggttgtgcgtctgaagcctacaagaaagtttgcctatctggggc

SEQ ID NO: 70622 - DNA, 201 bp, Homo sapiens
ccccacaagaccaagcgaggccaggccgctctggaccgcctcaaggtgtttgatggcatcccaccgccctacgacaagaaaaagcggatggtggttcctgytgccctcaaggttgtgcgtctgaagcctacaagaaagtttgcctatctggggcgcctggctcacgagtttggctggaagtaccaggcagggacagccacc

SEQ ID NO: 70623 - DNA, 201 bp, Homo sapiens
ccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaag

SEQ ID NO: 70624 - DNA, 201 bp, Homo sapiens
cattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagc

SEQ ID NO: 70625 - DNA, 201 bp, Homo sapiens
attttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagcg

SEQ ID NO: 70626 - DNA, 201 bp, Homo sapiens
tctggccacccacctttgtcatatacttggattcatgcaaatatttcagttccctgaatacctcaagctattttcggtgtgtgtgttttttttgttttttkttgttgttgttgtttttgagacagagtcttgctcttgttgcccaggctagaacgcaaatgtacgatctcagctcactgcaacctccgcctcctgggttca

SEQ ID NO: 70627 - DNA, 201 bp, Homo sapiens
cactaattgttaaaaaaagaatcaactgttcttactctagagctcttttttcctttctgctgatttgctggaagcactacaagacttctgtttgttcgttygtttgtttgtttgtttgtttttaaagatggggtcttgttatattgcctaggctggaatgcagtggttattcacaggcatgattataacacactactctct

SEQ ID NO: 70628 - DNA, 201 bp, Homo sapiens
cctgtaatcccagcacattgggaagatcacttgaggcaaggagtttgagaccagactggccaacacagcgagacccccatctctaaaaaaaaaaaaattartaagacatggatacaaccagggagggaggttataataatagagcatcctgttaatcagaatcatgggggagaacatacagcccagcgtgcctctcacttt

SEQ ID NO: 70629 - DNA, 201 bp, Homo sapiens
gaaatctaagctgcatgaacccgggtaggccccttcccagggccccagtttctgtgtccatcaaagaagctggagaataactcggaatgtatacagtgcartgctatttgccaagctctttcactgcctgttatttcaatctgttctcatggtaggcagagcaaacattgttattcccatttttatggaggttcagaatgt

SEQ ID NO: 70630 - DNA, 201 bp, Homo sapiens
tgcatgaacccgggtaggccccttcccagggccccagtttctgtgtccatcaaagaagctggagaataactcggaatgtatacagtgcaatgctatttgcyaagctctttcactgcctgttatttcaatctgttctcatggtaggcagagcaaacattgttattcccatttttatggaggttcagaatgtttaagtaagct

SEQ ID NO: 70631 - DNA, 201 bp, Homo sapiens
gcggtcggcagcgcgtgactgcatgcgacccctggcgcaagcgcaacagcccagccctagcttgggagcggacccacacgaactgctcaaaggcttggagsgggtctagtaaggcgaacggactgcttccggccagaggtcccgggcggaggaggaagctgtggctgccggcggtgggacgccccggccgctcagcccccg

SEQ ID NO: 70632 - DNA, 201 bp, Homo sapiens
cggtcggcagcgcgtgactgcatgcgacccctggcgcaagcgcaacagcccagccctagcttgggagcggacccacacgaactgctcaaaggcttggaggrggtctagtaaggcgaacggactgcttccggccagaggtcccgggcggaggaggaagctgtggctgccggcggtgggacgccccggccgctcagcccccgg

SEQ ID NO: 70633 - DNA, 201 bp, Homo sapiens
tgaagtgcactgcccatccatgctccattccagttgattatctgcacatttatgttccagtagtactccgtaacctctgatttagttttcacatgctctartgtttgtcttccctggtaggctcctcaaaggtgggcactatgctccattcatctctgtatggctggcatcaagcatactgcttaatacatagtacatgtc

SEQ ID NO: 70634 - DNA, 201 bp, Homo sapiens
aactgtactgctgtcctgcagccactgaatcttggcataattcacaccatgaaagtactgtaccggagccaccttctaaaacagatcctcctcaagctcamcagcagtgaggatcagaagaggtggacatcaagcaggccatcgacatgattgctgcagcgtggtggtcagtcaagccatccacagtggtgaaatgttggc

SEQ ID NO: 70635 - DNA, 201 bp, Homo sapiens
cagctatatagcactctgtagtgtttggagtgctagctttgttgtgagcctcctgggtttgaatcccagccctgccacaagtaagcaatattaagcaagtraagtgcttaacaaatgaggtttacgcagtagatcctcccacctcagtaaatggcaccatcatctgctggattcctcagtgctcaaaccagaaacctgggc

SEQ ID NO: 70636 - DNA, 201 bp, Homo sapiens
gcctcccgggttcacaccattctcctgcctcagcctcccgagtagctgggactacaggcgcccgccaccacgcccggctaattttttttgtatttttagtrgagacagggtttcaccatgttggccaggatggtctcgatatcctgacctcgtgatccacacgcgtcggcctcccaaagtgctgggattacaggcgtaagc

SEQ ID NO: 70637 - DNA, 201 bp, Homo sapiens
gccccgcctcacctttcagagccacgtcgggcgctgggaagcctacaataccaccctctcctcagcacgacgttcaaggcctgacctcagcctgtctcagyctttccctctcattcaggatcgggttcatacgtagtgccgcatcaagtagcgccttcatcactccagtgatctgccctcaatccgtctctcccactggcc

SEQ ID NO: 70638 - DNA, 201 bp, Homo sapiens
cacttggaaaggattcaggttgggtatctgccctccaactgtactgctgtcctgcagccactgaatcttggcataattcacaccatgaaagtactgtaccrgagccaccttctaaaacagatcctcctcaagctcaacagcagtgaggatcagaagaggtggacatcaagcaggccatcgacatgattgctgcagcgtggt

SEQ ID NO: 70639 - DNA, 201 bp, Homo sapiens
tctagacaggatacaccacaccattctccaaatacttcaatccctgtttcactcacttacgccaccatcctggcccctaaaggcatttgagtttgaagcayctatctagggtccaagacttaaatctggaaggaccttaggcatcatctgggcttgtggtttgcaaccatgggacttttcaaaaatatgtattaaaaaaaa

SEQ ID NO: 70640 - DNA, 201 bp, Homo sapiens
tccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaa

SEQ ID NO: 70641 - DNA, 201 bp, Homo sapiens
tccctctactttatctacattcttaaaggatcgcaccaaatttgaagaaaaggtgcgggaggcatccgtgggaccccagcggaaaaggatgaggagcgctytttatgatgacattgataaggctgtttttgcttggtttcaagaaatccatgccaaaaacattcttgtgactggttctgtcattcggaaaaaagcactaaa

SEQ ID NO: 70642 - DNA, 201 bp, Homo sapiens
atttctaattttggaatgtcctttccctttccttttatgcctggttaacttccacttggtgtaaacatttctccctttgggaaagctttccctgatccctrgaatagattgggtctctctctctcactctcccgctaagactgcctcctagaactgctcatgggaggtaataatgtgttcctttgtgtgattgtctgtttc

SEQ ID NO: 70643 - DNA, 201 bp, Homo sapiens
aatgctagtgtatgcatttatgtacattctccatctgcttccattagtgtcaaaatattctagaaatgtaaagtttaaaaaaagacagtattttcggaaaytgttttttttttgaaattatttttaggtcgatactgcaagcaacttgaactctggtaaagaggaccactccgaaagcagtaatacagagaacagaagaac

SEQ ID NO: 70644 - DNA, 201 bp, Homo sapiens
tcaatacgttgcacattgttacttctgcccaagttaccttcaatgaaaatggtttagtccattttcattcctaaccttatattataaggctgtattatgaktgtgccaagtacagttcctattgttttgatttgaatataactgcagctaccatagaggtctaagggaattttcattaccttccctttactccatgttgga

SEQ ID NO: 70645 - DNA, 201 bp, Homo sapiens
caattcgacatgagatttgggtggggacacagagtcaaaacatatcagatattatctggctgtgaccttattttttttttcttcagcagtcccttttttttccttaaaatatctagacttctagacttgatttttttacttaaagcattagttttctcatttatttcttttaaggttttaggaaatgaataattgaacatt

SEQ ID NO: 70646 - DNA, 201 bp, Homo sapiens
aattgtttgcctttcctgagtgctatttaataggattcacacttgcattctgttaccaaattaatggactttcttttaaagttaatacaaagcattaattrtagtctttttttttttttcagtgacttagtgggtttttcttaaccttacagtctagtgttggatagtaagataatcatccctatccagctgaggcagaag

SEQ ID NO: 70647 - DNA, 201 bp, Homo sapiens
gctatttaataggattcacacttgcattctgttaccaaattaatggactttcttttaaagttaatacaaagcattaattatagtctttttttttttttcartgacttagtgggtttttcttaaccttacagtctagtgttggatagtaagataatcatccctatccagctgaggcagaaggaagtcgatttgatttctcag

SEQ ID NO: 70648 - DNA, 201 bp, Homo sapiens
tctgttaccaaattaatggactttcttttaaagttaatacaaagcattaattatagtctttttttttttttcagtgacttagtgggtttttcttaaccttwcagtctagtgttggatagtaagataatcatccctatccagctgaggcagaaggaagtcgatttgatttctcagtactgttgagtgtggaaggctagagaa

SEQ ID NO: 70649 - DNA, 201 bp, Homo sapiens
ttaattaatattttaaaataatacaacttgcctagttttttgcttgggtgcctttgaataatgatcttcctcccctcctcacagccctttcccccactccmactatagccagaaagagaggtgaaagcagttgaacattagaaaagaagtcttttaatgtggtagttaactgtatttctgaaaactagatactgccctgct

SEQ ID NO: 70650 - DNA, 201 bp, Homo sapiens
aaggtgttaatggaatgcaggagagcaggctcctgaatggctgattaactaatatttttatatcctcaagtaatgttaaaaccatgcagtcttagtggaaraaaagagtgacttccagctgggcagaactctacttgatatgacccaaaaattaatatgtgtggttaggaagctgtatctcttatagaggcagttttactc

SEQ ID NO: 70651 - DNA, 201 bp, Homo sapiens
gtttggctttatcaatttctggacagtctctttgatttcctgtggtaacagattacatttctgatactactcgcttccttttgtgcactcctcacgaacaytcaatataattaaggcataatatttggttaaatcaacattcaatgcttacgtaattataactatttacatattgattgcttttttcttgtacaatgcttt

SEQ ID NO: 70652 - DNA, 201 bp, Homo sapiens
aaatcaacattcaatgcttacgtaattataactatttacatattgattgcttttttcttgtacaatgctttatttttcttgtggaatttctttgtggcagwtgcaatttcttctcaaatgcttaaatacatctataagatccaattttaataccctttaccaatacctttttctagatggccaaattcataagatagtctg

SEQ ID NO: 70653 - DNA, 201 bp, Homo sapiens
tactctccacttccatgagtttgacttttttttttttttttgtatttttagtagagatggagtttcactgtgttagccaggatggtcttgatctcacctcktgatctgcccacctcggcctcccaaagtactgggattacaggcgtgagccaccacacccagtctctttcatcttttgataatagttgttataacaggtgt

SEQ ID NO: 70654 - DNA, 201 bp, Homo sapiens
ggagtgaacctaatagaacagacctatttctagagcaaaatgaaagatttgtggagctctttagctgatccaggtcattgttggttgcctgtgcctgtgcytttattgacatgtattatgcggttctgcgcatgcttccatctcattgctccctctgcaagctgtaataagtctcccttgacaggctgcttagggcgttta

SEQ ID NO: 70655 - DNA, 201 bp, Homo sapiens
gctgggattacaggcgtgagccaccgcgcctggccaaaattgattgttaattgtgaaaaagcaagttgcaaagcaccatgccatttgtatgtgtgtctgckttggggaggagtcgatgggtataaaagatagaaggtttgcatatgcctaaaaaaatgagacctgcgagtctctattaacactaattcttgggataagccg

SEQ ID NO: 70656 - DNA, 201 bp, Homo sapiens
tttgcccaggctggaatgcaatggtgtgatcttggctcactacaacctctgcctcctgggttcaagtgattctcctgtcagcctcccgaatagccggggcyacaggcacacaccaataggcacacctaatttttctatttttagtagatatggggtttcaccatattggccaggctagtcttgaactcctgacctcaggcg

SEQ ID NO: 70657 - DNA, 201 bp, Homo sapiens
cattttttatgctggtaaattaattctagtcagattgaattagaatagtgtttctcaaaaagtggtctgcagagccctgggggtatggtgggagatggtgkccctgagacccttgcaggggctctgcaaggtaaaagctgttttcatagtaatgctgagatgctatttgcctttgtgtccaccatactgacatttgcactg

SEQ ID NO: 70658 - DNA, 201 bp, Homo sapiens
aagtggtctgcagagccctgggggtatggtgggagatggtgtccctgagacccttgcaggggctctgcaaggtaaaagctgttttcatagtaatgctgagrtgctatttgcctttgtgtccaccatactgacatttgcactgatggtataaaaggaatggtgggcaaaattgctggtgctttatcatgaatcaggacaatg

SEQ ID NO: 70659 - DNA, 201 bp, Homo sapiens
ggggtgggtgttacagaaagaagacactttgtggaaaagggccagcttttggaaagcttgggccattacagggaacagaattgatcagtaacatttatgarttaatcatagaaagttctgactttttgccaatgccataaagatatatgacattttagaaacttgaattttgctgaaccaagaacttgaatcaggctttct

SEQ ID NO: 70660 - DNA, 201 bp, Homo sapiens
gagagaaatagaaataaagtgctgtatttgatcaaaatagagaacagttatagcagagcgatttggaaaggctttgtggaaaatgtgaaatcagaattgarccttgaggaatgagtagggtttcatttggtatagatgggggtgggtgttacagaaagaagacactttgtggaaaagggccagcttttggaaagcttgggc

SEQ ID NO: 70661 - DNA, 201 bp, Homo sapiens
ggtagtcgctagtctccttgactccaaaacccacagtcataaccgctgcttatgcaaatgctattcccccaggtctttatctcttcctatattttctggakgcaggaaagtttgtggaacctgtatctggtgagacctggtgggtaggtgactctagttggattctctgtgctctttgggaaggctagctccctgctgagg

SEQ ID NO: 70662 - DNA, 201 bp, Homo sapiens
gagcatctgtattctgatcattgtcatctccctgaagttgtggtttcttttaggtgtgtattttgtgaatgcatacgattgcatcgactggtctgattttrtcagcagtgactagtctgtctacttctactttgtattcagagacattacctataagcagagttggtagcttcctaccaatatagttccatggatgcttgg

SEQ ID NO: 70663 - DNA, 201 bp, Homo sapiens
ctctctggagtgaaaagagtgtcttgtttgctaatgagatgactggtgactggaggctcctagataatttcaggatgaaggctggtcactggaaagaccaragcatgattagaaggttggaactttcagtccaccctagatgtccagggaggggagagggtctggagattaagctcatcaccaatgaccaaagaattaatc

SEQ ID NO: 70664 - DNA, 201 bp, Homo sapiens
ctttaagaaattagaacaaaggaagcagcatagaaaaaagatacaagctacatagagtacttgttttgagtttttttctttctatatgttgcaaccacttygtgtcactgaagacttacggctttctactgtagccatttgtgtacacgccttctctttcagttagtctgaagcagctttaggacaggattcttgtcttat

SEQ ID NO: 70665 - DNA, 201 bp, Homo sapiens
tttgcacatgttattcttccctgtttttcactttctcattcttaaaggcttattcaaatatcttcccctttatggtagaaaaactccactccatatcatckgaatcccaacattaaagcctaatacatgggtactgaccttctacctaaaaggctggttttgaatgagtgattttcagtatgagaaatgaatgactcaaga

SEQ ID NO: 70666 - DNA, 201 bp, Homo sapiens
aagatggactttggctaaagcaacagaaaatgaatttattgggagtcttgagtagtccatagactcagtgggaagtttggggaaccaggtttgtacaccgrgcagatgtccaggcagccataaacatggctttaggaacagcctggttaggggctggctgctgtggctccgcagccaccagacgtttgctttccacgagat

SEQ ID NO: 70667 - DNA, 201 bp, Homo sapiens
gttattattatcgttaatcataagttaatgacagaagttctaaagagtccttaatttcaaataagtgactatcaattgtactttaagaaattagaacaaargaagcagcatagaaaaaagatacaagctacatagagtacttgttttgagtttttttctttctatatgttgcaaccacttcgtgtcactgaagacttacgg

SEQ ID NO: 70668 - DNA, 201 bp, Homo sapiens
tcttttctgagctaggaaggagtcacattagttgagagactttatcactttcagtccagtacttccccagccccatgaaaaaaagtgtacccatcaaacartccccttctgccatctttatcttatcaggatctctcttctttaatagatgagactctttggaaaggactttaattggctgatgccacagactcatcccgg

SEQ ID NO: 70669 - DNA, 201 bp, Homo sapiens
atcataatccttatattgatatactacaatctacccactttccccctatttttagacgttttattataaatagtgtgacaataaattttttatcagtcacygttctgggttgcaagtaacaaagatggactttggctaaagcaacagaaaatgaatttattgggagtcttgagtagtccatagactcagtgggaagtttgg

SEQ ID NO: 70670 - DNA, 201 bp, Homo sapiens
tctatacttaatttactaaagtttatatcagggatttatataaaattttattaaatgcttttatgaatctatttatatgacatcctttttctcctttaaayttttaatgtgttaaaattaaaactaaaactaaaaaaatgcttttaagatatatacaaaatatatgatatatatatagaaaaataagccaattattattat

SEQ ID NO: 70671 - DNA, 201 bp, Homo sapiens
ctttcaaacaaccaaatttcatgagaacactgtcagaagaacagcaatgattcagtcacctaccaccaggcccctcctccgacactgggaattacaattcracatgagatttgggtggggacacagagtcaaaacatatcagatattatctggctgtgaccttattttttttttcttcagcagtcccttttttttccttaa

SEQ ID NO: 70672 - DNA, 201 bp, Homo sapiens
tctcttgcttcagagggcagaaatagaattatgggttttagaaggggagggttgataaaatgagagcagtgcctggagataggtactccatgaaaatgcarccccacgggggagaggagaaatcagagctgagagggaagaaggctgaactagagtggacaaggctagaaaaaagaaggcaaaaccgaaagaaagtagcag

SEQ ID NO: 70673 - DNA, 201 bp, Homo sapiens
ggtgatccatcatcccacaataataatgtcagtgctttcctgagtgagcccaaactcttttgcagagtttgaataatgttgagatcaatgcttttttcatytgctgagatgggaagagctgacctcctgatctcttaaacataagctttggcaccttgaatggttggaagccaagccgtaacatcgctctgtgtacctagg

SEQ ID NO: 70674 - DNA, 201 bp, Homo sapiens
cttcctctcttgctactttcctttgtggtttgataattttctgtgatggtatgctttgaatcttttccttttatattttgtgcaactattacaggtttttrtttgtgtttaccatcaggtttatataaaacatcttgtacaggctgggcatggttgtgcatacctgtagtcccatctacttggaaggatgaagtgggaaga

SEQ ID NO: 70675 - DNA, 201 bp, Homo sapiens
ctatttctagagcaaaatgaaagatttgtggagctctttagctgatccaggtcattgttggttgcctgtgcctgtgcctttattgacatgtattatgcggytctgcgcatgcttccatctcattgctccctctgcaagctgtaataagtctcccttgacaggctgcttagggcgtttacaagacatttggccttttggtga

SEQ ID NO: 70676 - DNA, 201 bp, Homo sapiens
tttaatagtttgattatgatttgtcttggtgcactcatctttggcttgaatttaattggagatctctgagctttctatacctggatgttgtcatatttccrcaaattttggaaactttcagccatattttcttaaatatattttctgggcctttttctttatcatatctttcttagaattttattataagaaagttagttt

SEQ ID NO: 70677 - DNA, 201 bp, Homo sapiens
ttcaggagtattaatgaagatattcttgtctgtaaatagttggttggatttttgttgggggtatgggagctgagcaacacccattctgccatcttcctgastagaacttccagctgtaatgtttttatttagcagcagagttcacttacaaatgcaattcagttagatgggtgtggtttgctttcttcacaccaaagatct

SEQ ID NO: 70678 - DNA, 201 bp, Homo sapiens
aacttccagctgtaatgtttttatttagcagcagagttcacttacaaatgcaattcagttagatgggtgtggtttgctttcttcacaccaaagatcttcakttaataaatgaactgtgaaaactttgttctactctgaaattgaagtatattgtccttctttttggataaagtgtttttattagaaagtatctgaatctcc

SEQ ID NO: 70679 - DNA, 201 bp, Homo sapiens
atggtggcaggcacctgtaatcccagctactcaggaggctgaggcagaagaattacttgaacccaggaagcggttgcagtgagctgagatcgcgccactayactccagcctgggtgacagcgagactccatctcaaaaaaaaaaaaaaaaaaaaatcatgtctgcttaggttgaaagataagtcaaatttccttatataat

SEQ ID NO: 70680 - DNA, 201 bp, Homo sapiens
acaaatgcaattcagttagatgggtgtggtttgctttcttcacaccaaagatcttcagttaataaatgaactgtgaaaactttgttctactctgaaattgmagtatattgtccttctttttggataaagtgtttttattagaaagtatctgaatctcctctgacttctgaaatcaaacttacaaaattggatgcaatcatt

SEQ ID NO: 70681 - DNA, 201 bp, Homo sapiens
atggattagatatttctcctaatgtttgagatgaaaatgttaaggatagttggatatttttccattaacttactttgtttcaactatcatttataatcaakttataaatatattagtaggtttcagtttcaaatttattttggaacaagagaggttataaatatactttgtattctacctatactgtaaacattttaaaaa

SEQ ID NO: 70682 - DNA, 201 bp, Homo sapiens
tagaatatctgaagttggagttttactaacctcattatttataattattaaaatagcttgctgatcaattttattctaaaatactaaattgtccattatgygctttctacaaaagtgtgcatcaaaactgaatgctgtgtcagttttcttgacaaaaagccctttgaagacataactaatgaggagttgctgcgtgtttgg

SEQ ID NO: 70683 - DNA, 201 bp, Homo sapiens
aagtttgaaatcaaggtgtcaccaaggccacacgccacctggaggccctaggagagaacgctagaacgcttccatgcttcttccagcttctcctggctatrggcattcctggctttgtggccacgtcactccagtctctgcctccgtcttcacattgcctccctccatctgtgtgtgttaatctccctctgtcttttttgt

SEQ ID NO: 70684 - DNA, 201 bp, Homo sapiens
tgaacccaggaagcggttgcagtgagctgagatcgcgccactatactccagcctgggtgacagcgagactccatctcaaaaaaaaaaaaaaaaaaaaatcrtgtctgcttaggttgaaagataagtcaaatttccttatataatattggttaatttgcattgattattcatatttagttgcctaagatggtaacctgaaaa

SEQ ID NO: 70685 - DNA, 201 bp, Homo sapiens
agcattctgtgttattaaatattcttctaaatcattcattatgatggctgcaatgtatcttatgatgtatcataatttaagcatttctttatttttggtcrtttatattaagactttttgtataagctaaaactatcatgagacaaaaatatggtcataatcattatcttcccattacatgatggtgtgatgagttcagag

SEQ ID NO: 70686 - DNA, 201 bp, Homo sapiens
agaatatctgaagttggagttttactaacctcattatttataattattaaaatagcttgctgatcaattttattctaaaatactaaattgtccattatgtrctttctacaaaagtgtgcatcaaaactgaatgctgtgtcagttttcttgacaaaaagccctttgaagacataactaatgaggagttgctgcgtgtttggc

SEQ ID NO: 70687 - DNA, 201 bp, Homo sapiens
attcatatttagttgcctaagatggtaacctgaaaactaatgttaatggattcttcattttttaaaggacaagctaaaaaacacagaataaatattaaaarttgtggaaagatagtcacccattttattttatgttaaaagtacacagttaatactcttgttaagttgcaaattaagttagtgtcagagcgtttttgtatt

SEQ ID NO: 70688 - DNA, 201 bp, Homo sapiens
gtatagaaatgctcctgatttttgtatgttgattttatatcctgtaactttactgatttttttttgtcacttctgacagttttttggtggagtctttagcrttttctatatacaagatcatgtcatcagcaaagagagatagtttcatttcttcatttcctattaggatgccttttatttgtttttcttgcgtaactctgg

SEQ ID NO: 70689 - DNA, 201 bp, Homo sapiens
acaacaacaaaaagaaatgtagagtgccaggcccactgcagacctactgaatcagagcctgaattttaagataccccgcaggtgatttgtgtgcatgttamagagtgagaagctccggactaaatggtttactacttacttctactttaggattatcaaaaataaatggtggtagtgaaaataatgtacagaaagtacctt

SEQ ID NO: 70690 - DNA, 201 bp, Homo sapiens
tttcttaatttcctatttagatagtttgttcttaatgtatagaaatgctcctgatttttgtatgttgattttatatcctgtaactttactgatttttttttgtcacttctgacagttttttggtggagtctttagcattttctatatacaagatcatgtcatcagcaaagagagatagtttcatttcttcatttcctatta

SEQ ID NO: 70691 - DNA, 201 bp, Homo sapiens
cgggccctcaacctgtctacttttcctcctctgcaaatgatggcatgaaatggaggcacacatgatcctctgagtttgagtagttaagaataaatgattgycttgttcttataaacattttttgatttttttctcttttaaaatattaatagttcagaacccttccaaaaaatgtcacttactttagtaaacttctgttgt

SEQ ID NO: 70692 - DNA, 201 bp, Homo sapiens
tttttctctaagttttatcaacttccataccctaataaactttggttgatgaaagtgatgagaaatagagaatgccagctcaagcaatagcacataattayaaatattttgatgtttttaactgattattggagaaaccatgtttttatcagctggtgtgtctttttccagaagacacgtgatttcatgatttgcctttaa

SEQ ID NO: 70693 - DNA, 201 bp, Homo sapiens
aattgcattaagctttctttgatgatgtgaattgggggagatagatacgtagtggttgaaaggaggaatctattaaaggcaaaagagaccacacgattttmtgggcttttccaacttgtatctaacaatttgtataggttgacttagaacagtgcagaaagaattggctttcaaatcgaagtgaggtaatctccagaggtt

SEQ ID NO: 70694 - DNA, 201 bp, Homo sapiens
ttttttgaacacccaggacaactctatgaaataagccccattttacagatgagaaaactgaggcttagagaagtaacttgcccaaagtcacacacctgctstgaggaggaaataatgcacttttcattcattagcgctttcaccagatgtcatatttatctattttttacagatggttaaaagaataatatggaaatttga

SEQ ID NO: 70695 - DNA, 201 bp, Homo sapiens
aattgctagtctagcttttaaaattctctatctatcactcgctctctatctatctatctatctaccccctcacagggctttaagcctcttgaaagaagtayaaagaagatagactgatgactgtccccctggtaactggcacttcagagagggtgagagaattcacagataattctcttttctgagctaggaaggagtcac

SEQ ID NO: 70696 - DNA, 201 bp, Homo sapiens
cttattgactggagttccccctacattacaaagcacctaataagatgatcttttcctatcagcattaaaaatttttttttcgactttgtagaaaataatcsttttgcagcacttaaagagaatcacttgcgggcattctgtaaaattttacattttactgacagcacaaaacaggaaattgttttttctttttggtgagta

SEQ ID NO: 70697 - DNA, 201 bp, Homo sapiens
cataatttgtgaccagactttaaaaaaacattgtggtcaatgatgttgcacaattactttttgtctgtcacatagacaaaacaaatccagatttaattcartgcaaacaaataaataaaatgctctgctaagagtatagagtcaagcttttgatctagtgggagaggctgagactgatcgaaaatataaggcagaaataaa

SEQ ID NO: 70698 - DNA, 201 bp, Homo sapiens
ggtagaaggaaagggaaatctctctggaagaacacaataatttaaacgtagaccttaataaattcccacaaataaaactgaagggccttgaatccacggtrgaggactcctcccatccccaacacataaagaaataaactatcatgagcaatcattaattgaaaaaacacactatagagtcagttccacgtagactgcaga

SEQ ID NO: 70699 - DNA, 201 bp, Homo sapiens
ttgaagaagggtaggaagggactggaatagagctagtgaagatgagaaaaaagcaatggtaaacaatcaggtagcccaggggaggttggaaaccctgctgygaaatggagccagtcaggaaggctgaaaggtttctctgacagccctcagcagtccaccaaagctggagatgagggttgatgagttgaggcaagggtgagg

SEQ ID NO: 70700 - DNA, 201 bp, Homo sapiens
gtcaatatgtctctccctgtccagagttagattgtcttagccttgtaagaaatgctgatatctgatagggtgcaggtcccctccttgcttttcgttttcaraagtatcttggctgttttaccatgtgaattttaaaatcaccttctcaagttccatgaacgacccatgtacgattttgactagaattgtacttaattttgg

SEQ ID NO: 70701 - DNA, 201 bp, Homo sapiens
atttaggattttttaaatgtatgctagtcacaggcacagaaatcttattgaccatctgctcatttccaaaacccatagaagccacaggagcatgcatttckgggtttgaggaacaaacaagaagttacttcagagctctttacctccagtgccaatctgttagatctccagttaaatctgggaaactgcccttgccacctc

SEQ ID NO: 70702 - DNA, 201 bp, Homo sapiens
tgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctca

SEQ ID NO: 70703 - DNA, 201 bp, Homo sapiens
ttgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctc

SEQ ID NO: 70704 - DNA, 201 bp, Homo sapiens
agaaactcgcttttgtacctaattttgaatttgtaattttgtattttttttttttttttttaagaaatgcccttctcttgcttcaagattatataaatttytggctctgtgaaacatgggtcagcttctgatgtccaaacatacaatcacctgggaatttcatttaaatattttaaattttatttctaagtgcatttttat

SEQ ID NO: 70705 - DNA, 201 bp, Homo sapiens
gccccattttacagatgagaaaactgaggcttagagaagtaacttgcccaaagtcacacacctgctctgaggaggaaataatgcacttttcattcattagmgctttcaccagatgtcatatttatctattttttacagatggttaaaagaataatatggaaatttgagttgcttgtcattttgcattaaacattgtgtgaa

SEQ ID NO: 70706 - DNA, 201 bp, Homo sapiens
tttagtagagagggggtttcaccatgttggccaggatggtttcaatcttctgaccttgtgatccgcccgcctcggcttcccaaagtgctgggattacaggygtgagctaccgcacccagcccaaatgctttttttactaaaggcacataagcagagaataaacagtttgcttgtacctcataggggcagcagaataacttc

SEQ ID NO: 70707 - DNA, 201 bp, Homo sapiens
tcccaagtagctgggattataggcatgcaccaccatgctccagctaatttttgtatttttagtagagagggggtttcaccatgttggccaggatggtttcratcttctgaccttgtgatccgcccgcctcggcttcccaaagtgctgggattacaggcgtgagctaccgcacccagcccaaatgctttttttactaaaggc

SEQ ID NO: 70708 - DNA, 201 bp, Homo sapiens
taaggtcaagaacttgctagatccggccctttgaaagagtgtacttactagagtaattggggaaatggaaatatggagagattactggaacatgtgtcctsttcaggataaagtttctagtaactcaatacatgccttgatctttggtatgcatgtatctatctggcaaatggattttttttttttttgagacagagtctc

SEQ ID NO: 70709 - DNA, 201 bp, Homo sapiens
agtggaataaaccccagatgatgcatccacagggcttttgtttttgtatctcttttttttgaccaccaaaaaaaccacttttttaaaattatatatatttraagtatacaacatgatgttttgatatacattgtgaaatggttattatagtcaagcaaattaacacattcatttcacatagttaccctctttgcgtatgtg

SEQ ID NO: 70710 - DNA, 201 bp, Homo sapiens
tggtttatttcacttagcataatgtcatccatgttcattcgtgtggcaaatggcaggatctccttttttaaggctaaataatatttctctgtatgtgtgtrtatcacagtttctgtatccattcatccatcaacagacatttcagttgtttcagtatcttgactattgtgaataatgctgcaatgaacaaggaaatgtgga

SEQ ID NO: 70711 - DNA, 201 bp, Homo sapiens
gcacaacaggttactcacatgtttgtggtgaagctggtgtaaacaaacctactgtgctgtcattcgtataaaagtatggcacatacaattatgcatagtaygtacttgacagtgataataaatgactatattactggtttatggatttcctatactatacttttaatcattattttagagtcttttacttattaaaaaaat

SEQ ID NO: 70712 - DNA, 201 bp, Homo sapiens
acttgaacccaggaagcggttgcagtgagctgagatcgcgccactatactccagcctgggtgacagcgagactccatctcaaaaaaaaaaaaaaaaaaaaatcatgtctgcttaggttgaaagataagtcaaatttccttatataatattggttaatttgcattgattattcatatttagttgcctaagatggtaacctga

SEQ ID NO: 70713 - DNA, 201 bp, Homo sapiens
gagtctcctctcccgtccacaggactggcagcccggcccccagtgttcaggccagggacggcctgaaagtggggccttactggggaccctgcccccttccrccccggactctgtctgcctcctgctgccgttcatggccctggggctcggccccaaccccgctccgagattggagctggggactgggagcggagagaggcc

SEQ ID NO: 70714 - DNA, 201 bp, Homo sapiens
tacttgaacccaggaagcggttgcagtgagctgagatcgcgccactatactccagcctgggtgacagcgagactccatctcaaaaaaaaaaaaaaaaaaaaatcatgtctgcttaggttgaaagataagtcaaatttccttatataatattggttaatttgcattgattattcatatttagttgcctaagatggtaacctg

SEQ ID NO: 70715 - DNA, 201 bp, Homo sapiens
agtttttttttttcagtacttgcctgtaaatcatagtgctgaaaagtgcttttgaacattgtgtatctagatactgctcctcatccatggtggagatgctyatttgtcccagcttctgaatttgaaactactttggcagaagttctcatgagttcttggagaccataaagcaaatcatgggcaattaaaacaaaggtctct

SEQ ID NO: 70716 - DNA, 201 bp, Homo sapiens
tcactgaataatgcctgtaagaaacattttaaaaacctagttgtccctttgagacttttgtctatttccttttttatctccccttggacagtattttatcstggaacttaattctgcaaccccttttgtttcacaccttatttttctcaatacgttgcacattgttacttctgcccaagttaccttcaatgaaaatggttt

SEQ ID NO: 70717 - DNA, 201 bp, Homo sapiens
ctcaggaacagccgttttaaatgctcaagcctaattgatacggacatggcacactcggccgggcagctggaagttaatgcattttcctgtagcgaggggargtgttcgggacagtcgcaggcattcagctgtgatgagcatgaaatttcaggagggaggtgtgtttggaaggatcgagcctataggcgaaatttcagaaat

SEQ ID NO: 70718 - DNA, 201 bp, Homo sapiens
ctgttttagcgatgggagaagaaagagtgagctaaggggcagtataggaaccctgggggttactggaaacgcctgcatctaggattgatttgtcagtaaakgctggaaaagtagcttaattctgtgtttcagggttaggctgaggctgctgatacacatttgtcttggtcaagactggttgaggaagtgggatttgattta

SEQ ID NO: 70719 - DNA, 201 bp, Homo sapiens
tcagaaataaagaccagacttgatgttcccacttatttgggtaacacctactgtttttttacaaaaagaaagaagtacattgtctcaatttccccagatayatctagaagctccagaataaattcaggcaatttgagactcacaagtattaaccagtctctaatgggtagttggcaggcttatttctgatcagaaaacact

SEQ ID NO: 70720 - DNA, 201 bp, Homo sapiens
gggcttggcagtgtgcgcccgtagtcccagctacttgggaggctgaggcaggagaactgcttgaacccaggaggcagagattgcagtgagccgagattgcrccactgcacactccagcctgggtgacagaatgagactccgtctcaaaaaaaaaaaaaaaaaaaaaaaaagaagtaggaatggtagggaagtgtaaggagg

SEQ ID NO: 70721 - DNA, 201 bp, Homo sapiens
caaacaagagagtagttttctgttggttggggcgctctacaggcttctctgcccatccagtcttctaactccactctgctctaaatcatttccctggtccyattatataagctttatatagggggcttggtggttaagggccagactgcttggggtttgaatctcacttagtagctgtgtgaccttggcaggtcccctgag

SEQ ID NO: 70722 - DNA, 201 bp, Homo sapiens
gtctcaggcataagcaggcagcctgtagatggtgagtaggtggaggagctgtgctttgagctcttttcacatgtcagggagtttgtgctgaggcacctgcwgcttgcctagttggttcccatggtattaggtgtagtggctttagccatggataagagtttttccaccaggttaactacttgtatggagacaatctgagat

SEQ ID NO: 70723 - DNA, 201 bp, Homo sapiens
aggtgagtgtctcaggcataagcaggcagcctgtagatggtgagtaggtggaggagctgtgctttgagctcttttcacatgtcagggagtttgtgctgagscacctgctgcttgcctagttggttcccatggtattaggtgtagtggctttagccatggataagagtttttccaccaggttaactacttgtatggagacaa

SEQ ID NO: 70724 - DNA, 201 bp, Homo sapiens
cgtggtggctcacacctgtaatcccagcactttggaggccaaggtgggtggatcacaaggtcaagagattgagaccatcctggccaacatggtgaaacccygtctctactaaaaatacaaaaattagccaggcatggtggtgcatgcctgtaatctcagctactcaggaggctgaggcaggagaatcgcttgaacccggga

SEQ ID NO: 70725 - DNA, 201 bp, Homo sapiens
caggacgactgcgtcactgtacactgtccagaggtgactggctgagggaaagaagtggctgaaatctgctgtgttccatttgatgaatggtgcttgctggmacactgcttcttcttacacaggaggctccagtcactggccaagccttgcagtggggcgactttcatctggggccactgccctgttgctggcactcagaac

SEQ ID NO: 70726 - DNA, 201 bp, Homo sapiens
cagtcaaaagaaagaatggcatattactgctctttctgtagtgtgaataatatgtggttgcagtttttacatctgctttttattttcattttgtcttagcwagagaactaattgaagcaattttttcttaagatctgtggtttaactgtgcatacttttctttatccatctcctaaccctcaacaaatcagttcgttcttt

SEQ ID NO: 70727 - DNA, 201 bp, Homo sapiens
ggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaagt

SEQ ID NO: 70728 - DNA, 201 bp, Homo sapiens
tggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaag

SEQ ID NO: 70729 - DNA, 201 bp, Homo sapiens
gagaatggcatgaacccgggaggcggagcttgcagtgagccgagatcgcgccactgcactccagcctgggcgacagagcgagactctgtctcagaaaaaaraaaaaaaattaaatcgggtcgggttaaggatgttcccttctctatacttaatttactaaagtttatatcagggatttatataaaattttattaaatgctt

SEQ ID NO: 70730 - DNA, 201 bp, Homo sapiens
tacatcatattattaacataacattgctattaatgttaactctgttcacctggctgaggaaatatttgtaagatttttccactgtaagttaccatatttcmccatcctttgccacactctactctttggaaagagattgctatttgcagcccctgcttaaggagtggtgctgggaaaacttgctaaccataggaagagaga

SEQ ID NO: 70731 - DNA, 201 bp, Homo sapiens
gtaggctgaggcaggagaatggcatgaacccgggaggcggagcttgcagtgagccgagatcgcgccactgcactccagcctgggcgacagagcgagactcygtctcagaaaaaaaaaaaaaaattaaatcgggtcgggttaaggatgttcccttctctatacttaatttactaaagtttatatcagggatttatataaaat

SEQ ID NO: 70732 - DNA, 201 bp, Homo sapiens
tccgatatcatagactacatttcaaatctaaatgtatacctttatatttttcttaatataaagcactgggtcttaaataagtattagcttttatacttagmaataagaaaaaaaggaattttgaagtttaaagtttctattgaaatggagcaaatttgctaggcaaaaccaccccccaccacacacacacatgcacacaca

SEQ ID NO: 70733 - DNA, 201 bp, Homo sapiens
gcctgtagtcccagctacttggtaggctgaggcaggagaatggcatgaacccgggaggcggagcttgcagtgagccgagatcgcgccactgcactccagcytgggcgacagagcgagactctgtctcagaaaaaaaaaaaaaaattaaatcgggtcgggttaaggatgttcccttctctatacttaatttactaaagttta

SEQ ID NO: 70734 - DNA, 201 bp, Homo sapiens
tcttaaataagtattagcttttatacttagcaataagaaaaaaaggaattttgaagtttaaagtttctattgaaatggagcaaatttgctaggcaaaaccrccccccaccacacacacacatgcacacacacacgcgcacacacacatgcacccacacacgcacccacatgtgcatgaaataggaaaatagtatagtctct

SEQ ID NO: 70735 - DNA, 201 bp, Homo sapiens
tttggccggatgcagtggctcacgcctgtaatcctagcactttgggaggccgaggcgggcggatcacaaggtcaggagatcaagaccatcctggctaacayggtgaaaccctgtctctactaaaactacaaaaaattagctgggtgtggtggtgggtgcctgtagtcccagctacttggtaggctgaggcaggagaatggc

SEQ ID NO: 70736 - DNA, 201 bp, Homo sapiens
tggaaggagcagccttaaattctgtggcatgattttggttgtgattgggtagcctactgttgttcctgattgttttccagtaccttccatagccttctcartgattatgtgggaatatccaccatcgtttcaattaattcagtttctgcttaaagcagccagtcttagttttgttatttctgttatttgcaagtaagaacc

SEQ ID NO: 70737 - DNA, 201 bp, Homo sapiens
gtgagtttataattgatgtgcatttccctgatcactaatgaggtcaaatatttattcaaatacttatgtctaatatattccaccccccctttaaaaaaaaagcctattcatgtcttttgcccagttttttttgaattgtctgagtttttcttgttattatagaagttctttatatattcttgattctaatcttttggtggt

SEQ ID NO: 70738 - DNA, 201 bp, Homo sapiens
tgattgggtagcctactgttgttcctgattgttttccagtaccttccatagccttctcaatgattatgtgggaatatccaccatcgtttcaattaattcartttctgcttaaagcagccagtcttagttttgttatttctgttatttgcaagtaagaacctagattgatagggagtttgaaaccaggaatggttccgggaa

SEQ ID NO: 70739 - DNA, 201 bp, Homo sapiens
agaatagaacttcctaagaattcataaaaggcaaatttagcttgttttaattaacaaagagaaaaactgattcaaagacactaaacagcttagtaaactctgctgaagaatgaacctgtgtatatggatagctgaacacccagacaagatccattcttttcaattctgttttgagacctttgtagtagggactttccctgg

SEQ ID NO: 70740 - DNA, 201 bp, Homo sapiens
gagaatagaacttcctaagaattcataaaaggcaaatttagcttgttttaattaacaaagagaaaaactgattcaaagacactaaacagcttagtaaactctgctgaagaatgaacctgtgtatatggatagctgaacacccagacaagatccattcttttcaattctgttttgagacctttgtagtagggactttccctg

SEQ ID NO: 70741 - DNA, 201 bp, Homo sapiens
acagtgacacaaatatttgtttttcgtggaaaaatttggtagttctccctaaaatcttccctatgttttgaacttatagcttaaattctctttttgtttgyaattactaatatattattagtaactagttaattttaatgcattccaaatctttcttggcctacttcatgtttttcttgctcaacataaagacatgtcatt

SEQ ID NO: 70742 - DNA, 201 bp, Homo sapiens
gctaaccctcaaggctcagttgctttgaggtggtatgtgacagcacatttccagcctgtgaatgatgttttttttttttctttaaattagaaacctgaccrtgatggtgaaagaaatatggaagtaactccaggagaaaagatacttaggaacaccaaagagcaacgcgatctgcataatcggctgagagagattgatgaa

SEQ ID NO: 70743 - DNA, 201 bp, Homo sapiens
taagtattatgttagacgtaggtgttatcagaatgaagaaggtcccttctattcctaatttgctgagagtttttttttttaaatcatgaatgtatgttgamttttgtcaaatgcttttctgcattgattgatgatgactgtttttccttttaatctgataatctggtggattacatcggttgttttttgagtactcatcca

SEQ ID NO: 70744 - DNA, 201 bp, Homo sapiens
ctccttctgcttcccaaatgattacagaagttgggttcctttcctacttgttatatgtacagttggacatttacctcctaaaatgggaagactttaaagcrttatacatattgttttgaagggaagaaataattgtttgagaagcaaagctaaccctcaaggctcagttgctttgaggtggtatgtgacagcacatttcca

SEQ ID NO: 70745 - DNA, 201 bp, Homo sapiens
ccacagcttctctggaccctgcctctgctgttcaaaaaagcaaaagaaagatgagtcattttgtagggtaagaaaaggacattgttgggtagaggcaattkcctttttcattctgttatggttgaatgtataattgataggaatttaggaaaggatttgttggaagacacccattcacatgtaaatccgagtatgagaggg

SEQ ID NO: 70746 - DNA, 201 bp, Homo sapiens
agaaaaattatgcatacaagcatagttaacacttggtcatgatcctgtctgaggttttccctattcacacataccccaaatgcttaccttcccccatcccwacacacacacacacacacacacacacacacacacacacacacacacacacacacagacaccccttccccctcctcctttcctctcttcttcaatctcctt

SEQ ID NO: 70747 - DNA, 201 bp, Homo sapiens
taatagaaaaacagaaaatacagataagcaaggggacaagaacatccagaaacccaccaatccagaacccactactcttacttccttgatgtgtcatcatytttcaggtccctttgtgtatattcctttaataagagaagttggactttttaaagcaggattattggcaacttgtatgtctttctctattttttttgatat

SEQ ID NO: 70748 - DNA, 201 bp, Homo sapiens
ataagctaaaactatcatgagacaaaaatatggtcataatcattatcttcccattacatgatggtgtgatgagttcagaggatttgatttatttgagtttkctttctttcttttcctagttagtctagctaagggtttgtcaattttgtttatcttttcaaaaagccaattcttagttttgttgattttttctattgttgc

SEQ ID NO: 70749 - DNA, 201 bp, Homo sapiens
gaaggaccagaattcctggagggtgttgtatgttttgttttctcagtgcaagacatctttgaggtttcctttgccatcaaaggctttctatgtgtgtttgytggggatggcggggggatttataggaaaggactttcactgagatataaaataattttccccaggaggatttttactttgctagtcttgttttggtatcta

SEQ ID NO: 70750 - DNA, 201 bp, Homo sapiens
tgtggcaccaatgagctgctagaaattctgtcacgtactactataagagcaagaagtccaagcacttagggagataatattgttggaggggatatatcatrggtatggagagctgtattccaattgttttccttgagagggtcctgatgagatgctcttcaacaagagcctaagagatacagtgaggagggaccaactggc

SEQ ID NO: 70751 - DNA, 201 bp, Homo sapiens
acccagttttaaaagtttgtggctttctagaaatcatagtacagatggtccctgatttattatggtcaatttaatgatttttcaactttatgatggtgcaraagccatatgcattcagcagaaaccttaactcgaatacctataccaacattcttcttttcactttaggtacagctttcaagaaattacatgagatattca

SEQ ID NO: 70752 - DNA, 201 bp, Homo sapiens
gagcctaagagatacagtgaggagggaccaactggcttcattggaaaaaaaaaatttggctgttctctgtagacctctgatgcttgtgaagtatggtaccrttgaaatgggactccctaatcttactagggatattaggatcctggggtaatagagcttaagcagcagcaccttaccatcagaaagcaaggtgggtaggca

SEQ ID NO: 70753 - DNA, 201 bp, Homo sapiens
tttccctattcacacataccccaaatgcttaccttcccccatcccaacacacacacacacacacacacacacacacacacacacacacacacacacacacagacaccccttccccctcctcctttcctctcttcttcaatctccttccctctcctctccttccttcctcctttttttgtctttttacaaaccaggatcata

SEQ ID NO: 70754 - DNA, 201 bp, Homo sapiens
cctggggtaatagagcttaagcagcagcaccttaccatcagaaagcaaggtgggtaggcagcatggcttccataataggcagcaggatgggtatttaatcrggatgaccaggaatctttgggaatggctactgataatgggattcctgtgactgaaatgcataggtgcttagctatgccacctgatttttacaaccaaaaa

SEQ ID NO: 70755 - DNA, 201 bp, Homo sapiens
ttttccctattcacacataccccaaatgcttaccttcccccatcccaacacacacacacacacacacacacacacacacacacacacacacacacacacacagacaccccttccccctcctcctttcctctcttcttcaatctccttccctctcctctccttccttcctcctttttttgtctttttacaaaccaggatcat

SEQ ID NO: 70756 - DNA, 201 bp, Homo sapiens
ttagctatgccacctgatttttacaaccaaaaaactctgggtcttctggcaaatggaggcttgatttaagctattacaataggaaatcatagcccccatcygattgttcccagacaggtcagttcataagcccaacatcccttacatggaactaaggtcaagaacttgctagatccggccctttgaaagagtgtacttact

SEQ ID NO: 70757 - DNA, 201 bp, Homo sapiens
taaagaagaaaagaaaaattatgcatacaagcatagttaacacttggtcatgatcctgtctgaggttttccctattcacacataccccaaatgcttacctycccccatcccaacacacacacacacacacacacacacacacacacacacacacacacacacacacagacaccccttccccctcctcctttcctctcttct

SEQ ID NO: 70758 - DNA, 201 bp, Homo sapiens
gacaggtcagttcataagcccaacatcccttacatggaactaaggtcaagaacttgctagatccggccctttgaaagagtgtacttactagagtaattggrgaaatggaaatatggagagattactggaacatgtgtcctcttcaggataaagtttctagtaactcaatacatgccttgatctttggtatgcatgtatcta

SEQ ID NO: 70759 - DNA, 201 bp, Homo sapiens
gccaaccagtatctaatacatggaatgaggtttcaggccctgcctccactgaggcgcttcccactgggaagtactagagaatatttttaaagagtctctgyggacacagagcaagttttaggtttttttgtttttgtttttgtttggtatatctagaaacacactttgtgaatgtgaaaggttctcttgtacccaactaga

SEQ ID NO: 70760 - DNA, 201 bp, Homo sapiens
agttgagaatgtagtacagttataggtatttcgctgatgatcatgaattatcctgcaatgaataaatgacccagtaaccttttaaaagttattgactacadcaatataatttatgagaaatttaaaacataattagctggagttctttgagaggaaaatgtttttatttatttatttattattttttaaaattttacttta

SEQ ID NO: 70761 - DNA, 201 bp, Homo sapiens
aatgctttttttactaaaggcacataagcagagaataaacagtttgcttgtacctcataggggcagcagaataacttcattgccttgcttttaggcctctrtcttctttttggctctgtgttaccattttgtctgcaaggtttcacacagggcaccatgttagtccaatatattgtgacattgtgctcataggatcctggg

SEQ ID NO: 70762 - DNA, 201 bp, Homo sapiens
atgacagtgaagcttcattctctatgcctcaccattttcacagtaatgatcactgtgttttagatactttattttgttctgagaagtagctctaaacaggycacatgctagtgtggtgaagacaatgaagaaaggggaaaatggtttgagaaagttgcagttcttggccaaaaaatgaaattgctggataaatcaaagtag

SEQ ID NO: 70763 - DNA, 201 bp, Homo sapiens
cccagacttgtttcgggaaaggaagtgatagacatgtgataacagggccattccggcgacttgctcagaacaaagggcatctgatccaagtggacttgctstctctactgctagaaaacagctactgttggcaatcctcaaatggtaattgtcccacaaaatgaaaacataagagtccattttcaccagtcaccctgttag

SEQ ID NO: 70764 - DNA, 201 bp, Homo sapiens
tgctgcaaagctctaggatatgggtagtgaggcttacgttatagtcttgcgcggttttgttatgacataggaaggagagcagattttggccttaaatcatrtaaatggtaaagtggcaaccagagacttgaagctatgactcatagttcatgcaatgaacctctgaaacatttcatcaggtaaaccaggaaaacgactttc

SEQ ID NO: 70765 - DNA, 201 bp, Homo sapiens
gtgacttgtgggacacatgcagagagatgccatgtgggtgacttgtgggacatatgcagagagataccatgtgggtgacttgtgggacatatgcagagagmtgccatgtgggtgactgcacttcagggagtctttctgggggaaagtaactccttcactgccttccctctccccttggtcaaagtctgccccaaggggcat

SEQ ID NO: 70766 - DNA, 201 bp, Homo sapiens
tactgcatacagtactttctgatgctgaagacttaatagtgtcagccttgaagtgtaaaccttccgagggcgatgatagatgatagagaatcacatgccartctttacctcttgggtgccctctcccagcatctcatggcctctgtagcaccccctccccagcgccaggaatctacaagagtacacatgacagcttactca

SEQ ID NO: 70767 - DNA, 201 bp, Homo sapiens
aaagcctgtgttaactcaaagccaaatgacaggaaacctaaattaataggaattgtttttattcgaaggaggaaaatcataagaaaacaagctattattayattagtaagaaagcagagcacagagacttccgaagaatgttctgggggtgatatctgattgtttagctcttacctttataggattgtacagtgaatactt

SEQ ID NO: 70768 - DNA, 201 bp, Homo sapiens
ctaatattctgacagtgacacaaatatttgtttttcgtggaaaaatttggtagttctccctaaaatcttccctatgttttgaacttatagcttaaattcthtttttgtttgtaattactaatatattattagtaactagttaattttaatgcattccaaatctttcttggcctacttcatgtttttcttgctcaacataaa

SEQ ID NO: 70769 - DNA, 201 bp, Homo sapiens
aaataattgtttgagaagcaaagctaaccctcaaggctcagttgctttgaggtggtatgtgacagcacatttccagcctgtgaatgatgttttttttttttctttaaattagaaacctgaccgtgatggtgaaagaaatatggaagtaactccaggagaaaagatacttaggaacaccaaagagcaacgcgatctgcataa

SEQ ID NO: 70770 - DNA, 201 bp, Homo sapiens
accatcctggctaacatggtgaaatcccatctctactaaaaataccaaaaaattagccaggtgtggtggcaggcgcctgtagtcccagctactcgggaggmtgaggcaggagaatggcgtgaacccgggaggcagagcttgcagtgagccaagatcgcgccactgtactccagcctggaggacagagcgggactctgtttc

SEQ ID NO: 70771 - DNA, 201 bp, Homo sapiens
ggcaacatggcaaaacctcatctctacaaaaaaattaaaaaattagccgggcatggtggtgcgtatctgtagtcccagctacttgggaggctaggtgggaraataacttgagcccagcaggtggagattgtagtgagccaagattgagccactgcactccagcctgggtgacagagtcggaccctgtctcaacaacaacaa

SEQ ID NO: 70772 - DNA, 201 bp, Homo sapiens
cagcctccttcgtatctgggactacaggtgcatatcaccacatttggctaatttttaaaatttttttgtaaaggtgaggttttgtcatgttgctcaggctkatattgaactcctgggctcaggccatacacctgccttggcctcctgaagtgctagaattataggcatgagccactgcacctggcctgcatgcatatgtct

SEQ ID NO: 70773 - DNA, 201 bp, Homo sapiens
aaataagtgactcagcaccaccatctagtgcagaggccagagcttgtgctagctcattggaaatcaaaggagaaaatattaacatgacatgattagaaaaygttcacatgaaagatgggggctcttttttggtttgctgatttgaaatatttatttaaataaagtaaataaggagagctttccctgtaaatacttatgaac

SEQ ID NO: 70774 - DNA, 201 bp, Homo sapiens
tctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaacttc

SEQ ID NO: 70775 - DNA, 201 bp, Homo sapiens
atcacattttcagatgccggatagagtgtggagggggcatgttatggtaccatgctgctgccaggtgctccccctcgaaaaaggagtttaactaactcttstaagcatgtgtctgaagacaattagtgtgaaaaggccctaactttatagtctggcttcattttttttattagttctgggccctggaccattcaatttctc

SEQ ID NO: 70776 - DNA, 201 bp, Homo sapiens
ttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaactt

SEQ ID NO: 70777 - DNA, 201 bp, Homo sapiens
ttcagatgccggatagagtgtggagggggcatgttatggtaccatgctgctgccaggtgctccccctcgaaaaaggagtttaactaactcttctaagcatstgtctgaagacaattagtgtgaaaaggccctaactttatagtctggcttcattttttttattagttctgggccctggaccattcaatttctctgaggctt

SEQ ID NO: 70778 - DNA, 201 bp, Homo sapiens
atgattttccaattttccccactaggtagttggaagaggtaaatggaataaatactgtatgtggtgcatagtagatggtccagggctatcagccctgttcmctccatgccccacccccagtgcaactgactaatgacctgggctggtctggatacccacctaataagggacccgctgacagggagggaggtggacggattc

SEQ ID NO: 70779 - DNA, 201 bp, Homo sapiens
tttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaact

SEQ ID NO: 70780 - DNA, 201 bp, Homo sapiens
gcatagtagatggtccagggctatcagccctgttccctccatgccccacccccagtgcaactgactaatgacctgggctggtctggatacccacctaatawgggacccgctgacagggagggaggtggacggattcatctctttcttaaagtttcttgctctgtgtgaaagggaaactatttaaatgtgtcatttaagaga

SEQ ID NO: 70781 - DNA, 201 bp, Homo sapiens
taccaccctcaccagtgaaatgggtttgcatccgatctcaggtcactcacatctagtagtattgagtcggggagtctggtggtggacccttagttacctayctgaaccctggctataaaggttgctggtgaaaagcattttctgttctgtcttgggaaggtaagtttcctaaaagctagaagttccccacacatagcaagg

SEQ ID NO: 70782 - DNA, 201 bp, Homo sapiens
ccagttgaacttggaaagtacaggcttcagtgtacagcttccaagagaggccatctggctgctgctgctgctgccagcttccagacggaagctgagatttrctattgatgttccagcattgattgagctcctgcctcgtctgcatcaggcatggtcctcgcagcttcacgcaggtatttcatgctattgcaaattgttgct

SEQ ID NO: 70783 - DNA, 201 bp, Homo sapiens
gcttcagtgtacagcttccaagagaggccatctggctgctgctgctgctgccagcttccagacggaagctgagatttgctattgatgttccagcattgatygagctcctgcctcgtctgcatcaggcatggtcctcgcagcttcacgcaggtatttcatgctattgcaaattgttgcttgttagtattcctcccaactagt

SEQ ID NO: 70784 - DNA, 201 bp, Homo sapiens
ctgctgctgctgctgccagcttccagacggaagctgagatttgctattgatgttccagcattgattgagctcctgcctcgtctgcatcaggcatggtcctygcagcttcacgcaggtatttcatgctattgcaaattgttgcttgttagtattcctcccaactagttgtttggagtcagctagttgttagtatttttactc

SEQ ID NO: 70785 - DNA, 201 bp, Homo sapiens
tctgagactttgaaaggttaagtgatttgcccaataccaaacagctggggaatgagagagccggaatctaaagttagaaatgtcagcctccccctgctaasttctgctgttggtaagggtatttcctctccctctggggctttctattgctttcagagagagagtttgcaagctgaaggaacacttaacttgagaggcttt

SEQ ID NO: 70786 - DNA, 201 bp, Homo sapiens
tgtacagatgttttcatctggcattcagcgccctttgaaatacacacagctgccctttcagcctcatctaatcaatagttgccattctagttatgtgattytatattgaattcttcctgaacacttcttttaatcatttgttaaatgtattaattttctctgtctgtatgcaacagaaatggttgcatttagtgccttggt

SEQ ID NO: 70787 - DNA, 201 bp, Homo sapiens
atctaccagaaccgtccatggcctggggggtcaggagcccctgacctacaggacaaattaagctcccagatgggtctgcttttgcttacaaagggtttaaygattttttttagccaacatttaaaaattaggtaaattcctataaaaatccaaatttctagttctctcttgaaaaattcaaattagaaaatatgtcagcat

SEQ ID NO: 70788 - DNA, 201 bp, Homo sapiens
ggtttttaagtcagaaaactaggaaggtttataaaaacctttggaaaatatctgttgcatgctaaactaaagtgagagcttaataaaaatatgcattaatkcaggactccactgccctcagactaagcacaagagatctctgttgaaccttgggaaaaataaacttactcccttggcatttatgagggtggcactaaaatt

SEQ ID NO: 70789 - DNA, 201 bp, Homo sapiens
ccaggtctttatctcttcctatattttctggaggcaggaaagtttgtggaacctgtatctggtgagacctggtgggtaggtgactctagttggattctctstgctctttgggaaggctagctccctgctgaggcaacaggttctggaaactttgggggctatttggttattttgcactgaaaattaaatctaaaatgattt

SEQ ID NO: 70790 - DNA, 201 bp, Homo sapiens
tagatacagacaagtaggcagaactgtctgccccattctcctgccaacaacaaacaaaacataaaacataattccaaataagggaaatgcccattactcaractttccctttgaatctaataatgtcacccaagtcttgaggaatttgctaattgtttgtagatcctacaaggtcataatctagacctgttttaaaaaatc

SEQ ID NO: 70791 - DNA, 201 bp, Homo sapiens
taatttggggagaatttctaactttgtgatattaaatcttgtcatgtattaatattgtatctcagttgatctattaacttttaatttttagttaaaaaaaktcacatacaataaaattcacttttttggtgtatagttctatgagttttggaagatagattgagtgatataactaccattacaatcaagatatggagcagt

SEQ ID NO: 70792 - DNA, 201 bp, Homo sapiens
ggattattttaaccaaatgtaaaagtatctagaagccagcccctttctggttactttgtggttactgcatacagtactttctgatgctgaagacttaatartgtcagccttgaagtgtaaaccttccgagggcgatgatagatgatagagaatcacatgccaatctttacctcttgggtgccctctcccagcatctcatgg

SEQ ID NO: 70793 - DNA, 201 bp, Homo sapiens
tgcgcttgaagagactcacctggtgccctgactgggattattttaaccaaatgtaaaagtatctagaagccagcccctttctggttactttgtggttactrcatacagtactttctgatgctgaagacttaatagtgtcagccttgaagtgtaaaccttccgagggcgatgatagatgatagagaatcacatgccaatctt

SEQ ID NO: 70794 - DNA, 201 bp, Homo sapiens
tgaggaagcacacctcaggatttgatgtgagggcaacaggaaatgagtaaacatttgaaatagagtttgcttcctgaggagggtgtgcgcaggcagagagsgctgaggggcagcctgaggagtaagagaaaaactgactaatggggcacgtgcccctgtgcgtggaacatgggatgaacctggcttagcttcagccctgcg

SEQ ID NO: 70795 - DNA, 201 bp, Homo sapiens
tctcgtcccagatatgccagtagaaaccacctattaatccatgagccccaaggatcctgaagcatcactttgcctcctatctcctatggcgttgacagtgytggccataaccctgcagtacctgcacccagccagtgccagcatgtgagccttgttgacagtctgcagaggctggttggagctgctaaccctgtgcttcca

SEQ ID NO: 70796 - DNA, 201 bp, Homo sapiens
acctgcacccagccagtgccagcatgtgagccttgttgacagtctgcagaggctggttggagctgctaaccctgtgcttccaggcccacgctgtttggttyggttcgagttgcccttcagagccctgcccagccctgacttggaagctgttgcttattgtgtcttagtgtggagcagtggggcctgaggcaaaagtatatt

SEQ ID NO: 70797 - DNA, 201 bp, Homo sapiens
ccatgtgggtgacttgtgggacacatgcagagagatgccatgtgggtgacttgtgggacatatgcagagagataccatgtgggtgacttgtgggacatatkcagagagctgccatgtgggtgactgcacttcagggagtctttctgggggaaagtaactccttcactgccttccctctccccttggtcaaagtctgcccca

SEQ ID NO: 70798 - DNA, 201 bp, Homo sapiens
cttgtgagaactttctcactatcacaagaacagcatgggggaaaccacccctgtgttccaatcacctcccactagatccctccctcagcacatgaggattrcaatttgagataagatttgggtggggacacagagccaaaccatatcgctgacctacgggcagactgtgcaaggccaggtactaccttccaggccatgcca

SEQ ID NO: 70799 - DNA, 201 bp, Homo sapiens
gtactaccttccaggccatgccacatctccaccttctttcagcaccagtacaaggtggagggttttggatacactcccctgacctggccttaaatgaaccsctgtttgggaagatcctttacagacacagcacctccatcttcaggccagctcaacacagaagacacatgttgaagatcccagagacagagttctgaggat

SEQ ID NO: 70800 - DNA, 201 bp, Homo sapiens
agctcaacacagaagacacatgttgaagatcccagagacagagttctgaggataccttctcttcaattgtgaagtttagatgatatcaagcaaagtatttraagttctagagactcctgtgggcatacataagttctttaggtttcatttataccagatttctccaatgtgactcatctatcagctgatttcctgcaagag

SEQ ID NO: 70801 - DNA, 201 bp, Homo sapiens
gacacatgttgaagatcccagagacagagttctgaggataccttctcttcaattgtgaagtttagatgatatcaagcaaagtatttaaagttctagagacycctgtgggcatacataagttctttaggtttcatttataccagatttctccaatgtgactcatctatcagctgatttcctgcaagagggtgaggtttaatc

SEQ ID NO: 70802 - DNA, 201 bp, Homo sapiens
ggagaatggaaaagggagggaaggagctaggagaggaaggaagaacaagcccttttctcctatgaatccttagcgccattgatacagacattaaaatgaayaccaattatttttcccccttgatttttagatgtgtttaatccaaaagagctatagcaagtgatgtgagcctattgtgagcattcagactcgatagtgctg

SEQ ID NO: 70803 - DNA, 201 bp, Homo sapiens
taaaatgaacaccaattatttttcccccttgatttttagatgtgtttaatccaaaagagctatagcaagtgatgtgagcctattgtgagcattcagactcratagtgctgttctgtagcctaactggagtgcctttatttttctatgcacaggtaggtattttctgacaactagttctacatttatatctcaaataactct

SEQ ID NO: 70804 - DNA, 201 bp, Homo sapiens
cagtttaaccctctggttagctttattatttgggtaaacctttgtgacaaacaagttttggggagttgactgtttcctgtgctggtcaagatctttgggargctgtgaagtgcttgaggtctgggaccatacttcatttgcttctgtctcaacaaattcctggtgctcaatgaactttccttggccttcttggacctctta

SEQ ID NO: 70805 - DNA, 201 bp, Homo sapiens
tgcccctgagtgttccctcggggaagaccagggacatgtaaatgttttttcctggaggcccaggaagcaaccaagatggcattcacttctgtgttctcttytagccatattcagtatctaacatcctgggcagtatattttatgcatactgtggcataagattgaacaatccatgtacacaagatgtcttttggtgaagct

SEQ ID NO: 70806 - DNA, 201 bp, Homo sapiens
gaaggccttaaggattaactggatattgtggaattacagactttttctggcatttggcagaaatatgtttttgaacagggaaccctgtttaaccacctccyggattacataaagtagacactattttgcttatttataaattgggccttcactagtttcgttttctgctaggtctgttttcttctctgttaattcatggta

SEQ ID NO: 70807 - DNA, 201 bp, Homo sapiens
tcttttattcacctcaaaataccaaattatagcagccatatgtccccattttggctttaaatcatctatgttgattgcatttctcagaagcctctatgaaraactttaatcttgtttgaaatgaatgttatataagttggcacttgttacagtttagaatctggtcatatatctaatctatttaatcaagtatcatgaagt

SEQ ID NO: 70808 - DNA, 201 bp, Homo sapiens
ttagatgattccttaactattgagggcagttagggatgtttgtgatggagccctagtttagttcagttcagtatttgtaaataaattatatcaatatagtrccttaaaaaatggtttaagcactctaatcattcaattctcatgatagtcattgactgagctttgactgtgggcaagactctgctgggaatcaaaagatga

SEQ ID NO: 70809 - DNA, 201 bp, Homo sapiens
tttaatgtagagattatcttctaaagttcctcattttacagataaaggagatgagcccctgagaactcaggtgacatgctcaaggcagcaaagcttggatrgaagcccaggttctagtcttctgtgttttctttcctatccagctgcttcccccaggaggatcagggtaattgtagtccagcttatttctgtgtacacaca

SEQ ID NO: 70810 - DNA, 201 bp, Homo sapiens
agaagctttacctaatagtggagaattaactatactagtatcagtaatagctttttatttcagtactttacatatgcagaatatttagttattttttactrtgtaccttcagagtaggccaataacattattttactttgctgaagtagaaattaaagtcattgaaattcatgattaagttttcttatggggacttcttgt

SEQ ID NO: 70811 - DNA, 201 bp, Homo sapiens
aaatgtttttaaatatttaaggtcttggttgaaacacttagccctggtaacctttacaagcagagattaagtatgcatgatcaaatcattctccccaaatrcaccgcctctggaatgcccctggcctctgcctagacctgtagctttgcagcaacgacacattgcaggatgcaccacccttcacccttccttttctgtctt

SEQ ID NO: 70812 - DNA, 201 bp, Homo sapiens
gagattaagtatgcatgatcaaatcattctccccaaatacaccgcctctggaatgcccctggcctctgcctagacctgtagctttgcagcaacgacacatygcaggatgcaccacccttcacccttccttttctgtcttcagcagtattgtccactgatagttgtggacagacatgggagtgctgaatccccagaggtagg

SEQ ID NO: 70813 - DNA, 201 bp, Homo sapiens
tatatttgtattactggatgcctaccaaaaataaatgtgtttactcagtcaactgactatgtaatcttttggtttgtttcatcagttagagtccacatcaygtctctctgaagaacagttaaagtgtcttctggatgaatgcatacttaaacaaaaatccatcattaaactttcttcagaaagaaaaaaggaagacattga

SEQ ID NO: 70814 - DNA, 201 bp, Homo sapiens
aaaataaatgtgtttactcagtcaactgactatgtaatcttttggtttgtttcatcagttagagtccacatcatgtctctctgaagaacagttaaagtgtyttctggatgaatgcatacttaaacaaaaatccatcattaaactttcttcagaaagaaaaaaggaagacattgaggacgtaacacctgtgttcccccagct

SEQ ID NO: 70815 - DNA, 201 bp, Homo sapiens
gaagctcttgtcactgaagcagagaatatgaaatgccttcaattttccaaggacgttattattagtgacacaaaagactattttatgtcgaagactcttgscattgggagactgaaaaggccctccttcttagatgatccactgtatggtatcagtgtgagcctttcatcagaagaccaacatctgaaactcagttctcca

SEQ ID NO: 70816 - DNA, 201 bp, Homo sapiens
tctaaagtgctgccttaagccaagtgcctgtttaataaataaaagaatttaaatgtataaccagttttagaataaaacactgaaaatatggttcacatttmttctttacattaccaatgaaagtaggtaatgttgcttaagaattatgtaagtcacacattctatataaatatttggattttttgtttcttacatgaaatt

SEQ ID NO: 70817 - DNA, 201 bp, Homo sapiens
caatgcttttttcatctgctgagatgggaagagctgacctcctgatctcttaaacataagctttggcaccttgaatggttggaagccaagccgtaacatcrctctgtgtacctaggtgaagcctcaggttgtttatatttgtgctttctcctgtgtccacagcttctctggaccctgcctctgctgttcaaaaaagcaaaa

SEQ ID NO: 70818 - DNA, 201 bp, Homo sapiens
tggccagagcaagaggaagagagagagaagagggaggtgctacacacttgtaaacaaccagacctcatggtaactcattcactcacaatcatgagagcagyactgagggatggtgctaacccattcatgagaactccacccccatgacccaatcacctcccaccaggcgccacctccaacactgggggttacaattcgaca

SEQ ID NO: 70819 - DNA, 201 bp, Homo sapiens
taattatatacatttgtggggtaaagtatgatgatttgatgtatgtatacaatgtgagatgagtaaattaagctaatttacattatctatcacctcacttaccatttttttgtggtaagacacttgaaatttactcttagttattttgaaacatacaatatgtgattaatgactgtagttaccctgctgtgcaattcatct

SEQ ID NO: 70820 - DNA, 201 bp, Homo sapiens
tcatgggttttggagagcttttgggttggtatacatgtagaggtgctgggagggtggggtgcacagagaggacaatgacattctgtgctccttccacgtayatctccctatgcatctgttccgtttggctgttcctcagtagtatcctttatagtaaagcagtaatagtaagttaactattttcctgagttctgggagtca

SEQ ID NO: 70821 - DNA, 201 bp, Homo sapiens
aatttgcctagttctccagcttcacctttgtacctcattaccttctgctctttctgagttaggatcatatgagatgatggatgtgaaaggtcttggggtaygctgaagtgtgctatccatctagttatgttttgtatattctttattcccccatgtgaaacccagccgcagaggaaggtctgctaagttgctttataccaa

SEQ ID NO: 70822 - DNA, 201 bp, Homo sapiens
gataggaatagtatgaataataacttgtttatggaatactgggaaattagagctggcacgaaagatgaatactttgaggtgaatacttgaacagatggttdcttgacagtgcctgcacagtgagtggttcagttatggtgcttattagctcagaatttttgagagcaatctggaaaaaggctgtgggttagatgattcctt

SEQ ID NO: 70823 - DNA, 201 bp, Homo sapiens
gatggtttcaatcttctgaccttgtgatccgcccgcctcggcttcccaaagtgctgggattacaggcgtgagctaccgcacccagcccaaatgctttttttactaaaggcacataagcagagaataaacagtttgcttgtacctcataggggcagcagaataacttcattgccttgcttttaggcctctatcttctttttg

SEQ ID NO: 70824 - DNA, 201 bp, Homo sapiens
tacatggaatgaggtttcaggccctgcctccactgaggcgcttcccactgggaagtactagagaatatttttaaagagtctctgtggacacagagcaagtwttaggtttttttgtttttgtttttgtttggtatatctagaaacacactttgtgaatgtgaaaggttctcttgtacccaactagaaataatcactgactgc

SEQ ID NO: 70825 - DNA, 201 bp, Homo sapiens
ttctctgttcatttctagtaatgtccaatattgttattataaaccatgacagagtgagcatttgtttaattattgtcttaggatatattcttaagtggaaktgctgagagtgtatgtgtagagtttggctgtgtgttgccaaattgtcctccagagaggttgtgtaatttattcttgcactaagaatattctagagtgcta

SEQ ID NO: 70826 - DNA, 201 bp, Homo sapiens
acatgttttcagttgtttattggcagtttgtgtttcttcttcagtgcattgcccatttgtatcttttttcatttatttattttattaaggtattcttttcrttttgtattggaaagctgtctttatatatttaaaacatatactctttgtcacatatgttacagattttactacctctaaagtgttaattttatttactgt

SEQ ID NO: 70827 - DNA, 201 bp, Homo sapiens
taaagaccagacttgatgttcccacttatttgggtaacacctactgtttttttacaaaaagaaagaagtacattgtctcaatttccccagatatatctagragctccagaataaattcaggcaatttgagactcacaagtattaaccagtctctaatgggtagttggcaggcttatttctgatcagaaaacactctatatt

SEQ ID NO: 70828 - DNA, 201 bp, Homo sapiens
gatctcttgagactcattcactgttatgagaacatcatgggaaagacctgaccccatgattcaattatctcccacccggtccctcccacaacaggtgggarttaggggagctacaagatgaaatttgggcaggaacatagagccaaactgtatcaaatggaaaaaagtttattgaattaggatataaagaaagaaagtttt

SEQ ID NO: 70829 - DNA, 201 bp, Homo sapiens
tccaatcacctcccactagatccctccctcagcacatgaggattacaatttgagataagatttgggtggggacacagagccaaaccatatcgctgacctaygggcagactgtgcaaggccaggtactaccttccaggccatgccacatctccaccttctttcagcaccagtacaaggtggagggttttggatacactcccc

SEQ ID NO: 70830 - DNA, 201 bp, Homo sapiens
gggcaaaattgctggtgctttatcatgaatcaggacaatggcaccaaaatgtactagtagtcattgtattctttgcaaccaggcactggcaggaaaaagamatagccagtgtcactggctatgaatcagtaaaaactatcaattttatgaaattttgacccttaaatatgcatcttcttaacatcctgtggggaaaaatgg

SEQ ID NO: 70831 - DNA, 201 bp, Homo sapiens
aaaaagaaatagccagtgtcactggctatgaatcagtaaaaactatcaattttatgaaattttgacccttaaatatgcatcttcttaacatcctgtggggmaaaatgggaagtatacataaagcaattatgctgtgtaccgaagtttgaggttgtgttgaagaaaagtacttttgtgatggttggagttgagagctgaact

SEQ ID NO: 70832 - DNA, 201 bp, Homo sapiens
atttgaagtctccaccttggggacctaaaataaaaagagaaaaccataattatagttactcagtatgcatattctctgtattatgaacatcaagatttggrtgcattatctctggagagttaatgtgttattttagcacactcttacacatcctttttgtgcttaagttctagggaaatgctgtttaactatcttagcttc

SEQ ID NO: 70833 - DNA, 201 bp, Homo sapiens
gctcagttctgcaatcctagagaagagcctgagtgatccagctgggtcaggggcctacccctggctcaaccaacttgtccaacccagcaaggtttggggtsactgtaggaacatggcagctatgtcaataccagactggagaggagaagaggacatttccagtgaagacagttctggccagataacccaatgtgttttccc

SEQ ID NO: 70834 - DNA, 201 bp, Homo sapiens
tcctgtctcaaagatattataattgaaattagctgctgacacagtttacattggatttgtttatattgttttagtactgcatgagttacttcaaaatgccygctatatagactacctatgttcacggagcctgagaatgctaggattggcagttgggaatgagaactagaaggtgttgcttttgaagtacataagcaataa

SEQ ID NO: 70835 - DNA, 201 bp, Homo sapiens
aaggacccagttatctcaactgtaaaatagagataaatgtctgtttcatagggttgttagataattatatagacaaacacatgtgaaagcaccttgtaaaytgagatacatggtaccaatgtagtagttattactatcagctataaatatttgttgaatgaaagaacaaattgtaagaacaaaacaaaactttatagtttt

SEQ ID NO: 70836 - DNA, 201 bp, Homo sapiens
tgtgtccctcaaattcctggcccacagaagcatgagcataataaagtgttcactgttttatgccattaacttaaaaatttttattgtaaattgacaatttrtatttatggggtacaaaatgatattatgatttatgaatacaatatagaataattaaatcaagctaattcgcctatccatcacctcaaatacttaacatct

SEQ ID NO: 70837 - DNA, 201 bp, Homo sapiens
agtgttcactgttttatgccattaacttaaaaatttttattgtaaattgacaatttatatttatggggtacaaaatgatattatgatttatgaatacaatrtagaataattaaatcaagctaattcgcctatccatcacctcaaatacttaacatcttttatggtgagaccatttgaaatttagcctcttagcaattttga

SEQ ID NO: 70838 - DNA, 201 bp, Homo sapiens
tttttaaagctcctggcccgtatatttgacttaaatctatgctcacattgtatttctggagttatgtgactgctgtaggccctgtagacacttcccataaygttagattagtcctgatgttctaacatggaaattaagtggacttaatgatatgaaagctggagctgcaaggggcttgaaagctatgttaagagagaatca

SEQ ID NO: 70839 - DNA, 201 bp, Homo sapiens
tacagaaaagccaaattccttaatgaaatttcctgcttgctgtttacttcatagacatatgttttggagtcatttattgccacacatatctgttttttttwaattcttaaaaacaaaaaagtagttagcatttactttaggctgcattattaacctaattatattaatttgttttttggactacataactattaccttatt

SEQ ID NO: 70840 - DNA, 201 bp, Homo sapiens
ctgacctcaggtgatctgcccacctcagcctcccagagtgctgggattacaggcgtgaggcaccatgcccaaccgtcatgcataattttatggatgtaatmttctcttgaatctctctaggacggggactggtaccagttgggcccatggcctgttaggaactgggctgcacagccggaggggatgagcggtgggctagcg

SEQ ID NO: 70841 - DNA, 201 bp, Homo sapiens
gttgagatcaatgcttttttcatctgctgagatgggaagagctgacctcctgatctcttaaacataagctttggcaccttgaatggttggaagccaagccrtaacatcgctctgtgtacctaggtgaagcctcaggttgtttatatttgtgctttctcctgtgtccacagcttctctggaccctgcctctgctgttcaaaa

SEQ ID NO: 70842 - DNA, 201 bp, Homo sapiens
ttggcactgtaccatattaatttcaagaaggaggaatggtggggtaacattttatttgctatttttataaataatatttaagcctcctcaaaaatgggaasttcactactgctttaaaggtgtgccaagtttttctccaagaacagaagaaacggaaaaatcaagtaaaattttttgcttaagacaatagaaataaacatg

SEQ ID NO: 70843 - DNA, 201 bp, Homo sapiens
gactatgtgctctatgccaagcattgagtttgagtgagcgaatgagacaggcaggaatcacagctgtagtgtctgttctccagccttttaataatgttccscatgtgcctcagtgacctttccagattccttatatttggtttattttaaattttatttttaaaaattgtttatgatgaaaaatttcagacacacatgtgt

SEQ ID NO: 70844 - DNA, 201 bp, Homo sapiens
ctgtatttatttagtcttctttcatttctttcagcagcattttgtcatcttcagcatgtagatcctgtatgtgctttttgagacctgtacttaagtataamttgtaacactgtaagtggtattttttcttggtttctaatatgtgtgttttttcttttggtttctatgtatacaagaagtgtatatatagaaaaatggtta

SEQ ID NO: 70845 - DNA, 201 bp, Homo sapiens
tacttactacgttgtcaaggcagaaatacaggcccctccttctctctttcctctctcaatcctagggcatgctggtcattcttgcccctggagttagttgraggttggccatttttctgttttcccatggatgggtactggttttgtgaggatgggagaagggatagaagtaaaaaagaagtcacactaagtcttgtgttt

SEQ ID NO: 70846 - DNA, 201 bp, Homo sapiens
attcaattaaaactgttacaacatcataaatactcagtgatctctcctccccctacccttttctgataattcaattcagctaacctttcttgagccttatytgaatgtcgtgtgggctagagaatatataaaaactgcctgcatttactgagtgcttctgtctgggaggagattgttcttcctctctctaggcatggggac

SEQ ID NO: 70847 - DNA, 201 bp, Homo sapiens
cagacattgactggcacatagttggtgctcactaaataatatttgaatgaatacattctggacgttgaatgaaaggaccttttgggctctatgcatatctrattcagtggtcatattatttaggggtttagaatgaccatttcacttgttatcaccactatccatgtaatgttttaaaacttatcctcacttggatagctt

SEQ ID NO: 70848 - DNA, 201 bp, Homo sapiens
atgtcataagaaaatgctcattatgtactggtgaaaaacacattagtccaattttgttgaaaaagacagagcaaaaatgggaaagatgtaccaatagcgtwtagctcagggtggtgggatgttgggtgatttttatttcttttcaaataccttttagtacattctagagatctttctataataaatgaattctttagttat

SEQ ID NO: 70849 - DNA, 201 bp, Homo sapiens
ggaggaaatcacataactgtgctgactgacacaggcaaggattttggtttttaatttctgttggagtctcagcattgtttagcaatctcttgcattctccwaaatggtgattccaaactattactatgtgcttcatctcccatcttctgcaagaccttcactgtcttggttggtcttcctttccagagaaaatgaatctac

SEQ ID NO: 70850 - DNA, 201 bp, Homo sapiens
tataaactttgtctggattgagcttgtgactggtgtttttttcctttgtggacttgattgtggaaatgcatcctgttttgtagggtgaactgcatgtgttrtataaggagacattccttcttcgtgcatattttcagagctttaatgaagggttcacatgatcttgttttagaatattttaatgcgacacatagaaaacaa

SEQ ID NO: 70851 - DNA, 201 bp, Homo sapiens
tttttaatgaccttgacagttttgaggagtactggtcaggtattttgtagaatgtccaagagttggaatttatctcatgcttttctcatgattagactgaragtatgtgtttttgggaggaaaaccatggagttacagggtcattttcattacattacatcatattattaacataacattgctattaatgttaactctgtt

SEQ ID NO: 70852 - DNA, 201 bp, Homo sapiens
tcgtggggcagcctgccactgccaggactggcctctgggactctcgatttttgtgctccacattcatatgatcttcttcaggaaacctccatcttgttctstctctgtctttgcagtggcctgttgtatgtttattttctgttcaattttcctagaggagtagagttccccccttatccaggttcttgctaacacagatag

SEQ ID NO: 70853 - DNA, 201 bp, Homo sapiens
aaaaaccctgttttactaacacaggaacagataacaaaataccgcgggtgttctcacttttaagtgggaactaaatgatgagaacacatggactcatagargggagcgacacacactggggcctgctggagagtagaggctgggaggagggagaggatcaggaaaaataactaatgagtactaggcttaatacctgggtga

SEQ ID NO: 70854 - DNA, 201 bp, Homo sapiens
aaacattttgtatttttgtatattctagttgaaacatcaaaaaatactagtctggcctatattaaattcatagatcatttactttttgcatcttctgtttygttacggaggtaacacatgtataatctatataagaaaatattggttaaacaaaaaaaattactatcagctaaattctcaacttgtagagataaccactat

SEQ ID NO: 70855 - DNA, 201 bp, Homo sapiens
cagttcgttctttccacgtattgtaaatcccaccataaaactgagtgatgttctataatttagttaccatacttcttattcgtagaagtatcagattccakttctctccagaaatatctaagatataggagttatgtaagcattcagtttcttaaatccttagcaaccggattcaatagtaaattctattccatttggctg

SEQ ID NO: 70856 - DNA, 201 bp, Homo sapiens
tttctctcagttggtggtttgttcattttcacagtggtggttttgattaagcaacatttaaaaatgttgttaagtgcaacttataatttttttctttctgkgccttctctttgcttgccccaagatttagaaaaaatcatagttgtagattattaaaataatttcaatttaaaaatgaaatccggggtgttttgcagatta

SEQ ID NO: 70857 - DNA, 201 bp, Homo sapiens
aaatctcatgggcattatatttcagggagacctctatttccattttcagagagatttctctgattctgttgatgggatgaagtagaagaagtaggaatggkctgggtgcggtggctcacgcctgtaatcctagcactttgggaggccgaggcgggcagattgcctgagctcaggagttcgtgactagcctgggtaacaagg

SEQ ID NO: 70858 - DNA, 201 bp, Homo sapiens
ctctgaccatttcaatcagattctaactagggcaaagatcatgactgagaagttgtgcgtaatatgtatactcacatcccattggccaaatcttagtcatrtgaccatacacagcagcaaggaaggctgggaaatgagtcttgagttaagtgactgtatgggcaactagaaattatgataccatgtcaaaagaaaacagac

SEQ ID NO: 70859 - DNA, 201 bp, Homo sapiens
ccctattgcctaaagggttggggaccactgtctgagagacttcatttcattgctttaaaatcaagagagtagtgcaagatgacctctgttcttttgccagmgattcttggcacacttatttttgataagaagtgatgttatttgtaatatatagtatctaaaactagtttgtgtttcctaaatatttgttattaattggat

SEQ ID NO: 70860 - DNA, 201 bp, Homo sapiens
gcattgtcattattgcatcaaaatgtttagcactctaagccctgttgctgagcattgaggataagaatgtggctgacaaaggatgataaatcctctcattytgattcttatttcgacatgctcttgtcatttaacctgatataagcatatatgaaccccagtcagaagactggagtgttccttctgcttagagaatggggt

SEQ ID NO: 70861 - DNA, 201 bp, Homo sapiens
ggtgtgtagtacactctaccatctaggtttgtgtaagtacacccaatgatttttgcacaatgacagaattgcctaatggtacatttcttagaacacatatycctgtcgttaagcgacacataactgtaatttgtctactttattaacaaaagcttagataccagtaagaattaagggatctgggtttcattctggttttgt

SEQ ID NO: 70862 - DNA, 201 bp, Homo sapiens
aaagccttgtatagacactggggtgggcaatctttcctctgtgctcaaggccataggacatcccttcatatgtttgtagtaattttctctggagctcaaartggaaagcaatgggctgattattattttgacagtcataatttgtgaccagactttaaaaaaacattgtggtcaatgatgttgcacaattactttttgtct

SEQ ID NO: 70863 - DNA, 201 bp, Homo sapiens
ggatggtgtctgggttcgggaggacgcttgtgtagcatcatggcctggggatggcggggtggggggcggggtggcgcgtgaatctggtccttgctgttctstcagaggcgtatcttgtcctgcttggtctgtggatatgggaagccagctggggcatctgctgacttgtagctggtcccatttagcctttgtcatctgcca

SEQ ID NO: 70864 - DNA, 201 bp, Homo sapiens
gcaatgggctgattattattttgacagtcataatttgtgaccagactttaaaaaaacattgtggtcaatgatgttgcacaattactttttgtctgtcacawagacaaaacaaatccagatttaattcagtgcaaacaaataaataaaatgctctgctaagagtatagagtcaagcttttgatctagtgggagaggctgaga

SEQ ID NO: 70865 - DNA, 201 bp, Homo sapiens
atttatttgacaaataatagttgaatatatttatagggtacagtgtggtcttttgatatgtatatatattgtagaaagattaaatcaagctgataaatatrtatccatcacttcaccttcttatcatttttttttgtgatgagaatatttaaaatctattcttctgtgttccttcagtttttgtttcatcttcatgaaaac

SEQ ID NO: 70866 - DNA, 201 bp, Homo sapiens
aatgggctgattattattttgacagtcataatttgtgaccagactttaaaaaaacattgtggtcaatgatgttgcacaattactttttgtctgtcacataracaaaacaaatccagatttaattcagtgcaaacaaataaataaaatgctctgctaagagtatagagtcaagcttttgatctagtgggagaggctgagact

SEQ ID NO: 70867 - DNA, 201 bp, Homo sapiens
ataaatgacatgagagaaatagaaataaagtgctgtatttgatcaaaatagagaacagttatagcagagcgatttggaaaggctttgtggaaaatgtgaartcagaattgagccttgaggaatgagtagggtttcatttggtatagatgggggtgggtgttacagaaagaagacactttgtggaaaagggccagcttttgg

SEQ ID NO: 70868 - DNA, 201 bp, Homo sapiens
gaatttggtattggatcagatgggtgacaggagtgtggaattttgcagatgactcaggaagaaactcgttttcacattggaggtctgctttcatccactcyggatgacaggaaatagaaggaagtaaaattataaaagtagagtgaggccatgttgaatagcaggctgtgactggtggataaagttttctaagcagctatt

SEQ ID NO: 70869 - DNA, 201 bp, Homo sapiens
agagtatagagtcaagcttttgatctagtgggagaggctgagactgatcgaaaatataaggcagaaataaatgacatgagagaaatagaaataaagtgctrtatttgatcaaaatagagaacagttatagcagagcgatttggaaaggctttgtggaaaatgtgaaatcagaattgagccttgaggaatgagtagggtttc

SEQ ID NO: 70870 - DNA, 201 bp, Homo sapiens
gttcttccttactgataaaattctagttaaaaatgctgtctcagactcccttgtaactagggtgaccacataagttagttctggccagtcagataaaagcrgaagtctcctgataaaaagaaaaaccgctgacatgtgccttttgcccttcatcttttcccttcttagttggagcatagatacactgcctgaacattcagg

SEQ ID NO: 70871 - DNA, 201 bp, Homo sapiens
tgcaaagcaccatgccatttgtatgtgtgtctgcgttggggaggagtcgatgggtataaaagatagaaggtttgcatatgcctaaaaaaatgagacctgcragtctctattaacactaattcttgggataagccgaattttgacttaaaacattttgatattcacctgtattatttgatgttttttctgcatgggcaagta

SEQ ID NO: 70872 - DNA, 201 bp, Homo sapiens
agatacactgcctgaacattcaggaggcatcttgagaccacaagggcaggtcggaaagacagaggaggctagggcagttgtcccatcataaagctattgcwtcacctcttatctgtttacctctgaccaatttcttaagttggaaaataaaccaaccttggttatgccaggcaggtcattgggtttcttttatgaaagcaa

SEQ ID NO: 70873 - DNA, 201 bp, Homo sapiens
tttgccatccgtacatcatctggggtgatgtgtgtgtccaaatcctttgttttcttgttattgagtcttgatacttgtttatatattctggatatgagtcctttgtcagatatgtgttttgcaaatatttgctcctagtctttgggttttgttttccttgtcttaacatcttttgaagactacaagttttaaattttgatg

SEQ ID NO: 70874 - DNA, 201 bp, Homo sapiens
ctgaagttagaatatctcagaaatctttctttgggcagtatttgctaatgtaattattatttatcccagttcattccatacattaagtattctggaagggyatttaactcttcacattcttattggccaaccagtatctaatacatggaatgaggtttcaggccctgcctccactgaggcgcttcccactgggaagtacta

SEQ ID NO: 70875 - DNA, 201 bp, Homo sapiens
tggtgacttatgctttttggttttgatgtgaggggccagggtgatccatcatcccacaataataatgtcagtgctttcctgagtgagcccaaactcttttrcagagtttgaataatgttgagatcaatgcttttttcatctgctgagatgggaagagctgacctcctgatctcttaaacataagctttggcaccttgaatg

SEQ ID NO: 70876 - DNA, 201 bp, Homo sapiens
cactgtcccaagtattttacagatactaaagtatttaatcattgcaactgctccatgagataaataccacagtcctcattttatagatgaagaaatggagygaaagagaggttgactaattccttgaggttatacagctagtaagtggaggaggtaggattcaaatggttaacatttaataactatgctattactgccttt

SEQ ID NO: 70877 - DNA, 201 bp, Homo sapiens
gttaactcttacagctttgtaataattactgatatctgatagtggctcttccatattgtttgttttcaggactgtcttaactatccttggctttttgctcytctgtatgtatttttttttttttttgagtcttgctcttttgcccaggctggaatgcaatggtgtgatcttggctcactacaacctctgcctcctgggttc

SEQ ID NO: 70878 - DNA, 201 bp, Homo sapiens
tgagactccgtctcaaaaaaaaaaaaaaaaaaaaaaaaagaagtaggaatggtagggaagtgtaaggaggctcttggccagtcattgtagtggtaacgatrgtacattgtgaattcgatgtgataaatgaaatgttttggtttgattggttttgaaaactgttggtacttcctctcactccatatctgccaatccaaggcg

SEQ ID NO: 70879 - DNA, 201 bp, Homo sapiens
aatctcagctactcaggaggctgaggcaggagaatcgcttgaacccgggaggcagaggttgccgggagccaggattgcgccactgcactccagcctggcarcagagcgagactccgtctcaaaaaaaaaaaaaaaaaaaaaaaagacatggcctgtttttcaaagtggttgtacctttgtatagtcctgcaaacaatgtaa

SEQ ID NO: 70880 - DNA, 201 bp, Homo sapiens
acaggtaagattctgaaccatgggaaggccctaagaaatcttacaagcatccaggcccaaattagaataatcttattttacctataaaaatggaagctgarttcagatatctttcttgcaataaaggaaaaatatagtaactagggattacatattgcttctgttattgttttgtgaagacaacagaaagacattcttaga

SEQ ID NO: 70881 - DNA, 201 bp, Homo sapiens
tgccttggcctcccaaagtgctgggattacaggcatgagccactgcgtctggcctatatgtgctttagatcagttttttaagttctgaaaaatccggttgrggttttgattgaaattgctttgactttacagattaatttggggagaatttctaactttgtgatattaaatcttgtcatgtattaatattgtatctcagtt

SEQ ID NO: 70882 - DNA, 201 bp, Homo sapiens
gtcttggggtacgctgaagtgtgctatccatctagttatgttttgtatattctttattcccccatgtgaaacccagccgcagaggaaggtctgctaagttsctttataccaatataaatgacaggcagaacttgtgtgacttctcccagaaatgttagcattttcacaggacggaaggccttaaggattaactggatattg

SEQ ID NO: 70883 - DNA, 201 bp, Homo sapiens
tactctttgtcacatatgttacagattttactacctctaaagtgttaattttatttactgttctacaatattgaaaagttttgcaaggtgctatttttctytcttattttcatatggagtcatttgtgagaaatatatgctgggtattgcagcctgctttttgtttcttgaagtgatccatcaaaagcatttatatacttt

SEQ ID NO: 70884 - DNA, 201 bp, Homo sapiens
ttatagctattgcttcttaactggtctttctgcttccactcttgctgtcagtagttccagttttaaaatacagacctgatcatggtgtttctttgattaargtcttgttttctccagccccttcctgctcacagaggttagttgatcctctctggttcccatggtgcccagagcttaccagcactcttcacaccttgttaa

SEQ ID NO: 70885 - DNA, 201 bp, Homo sapiens
gcagataaatgggctaagaaagagattatgtgattgattatgacctttctatattgtacctgacttacattaagtatgtttttaatacttaaaactagttkactaaaaatgcctttaaaaatgagtctttatatatatatatcttttttttattttttattttatttgtttgtttattttttttgagacggagtctcactg

SEQ ID NO: 70886 - DNA, 201 bp, Homo sapiens
ttcagctcagaaaattatcttatattatttcttcctttccatcatctcttttttctccttttgggaggtatcagttgagaatgtgattggctgccagtaayagtggcttaaacagtaaagagtttacttttttctagtaacaagaaatccaggagtgagcagctcatgtctttctgtcctcctgttctacattcctatgcg

SEQ ID NO: 70887 - DNA, 201 bp, Homo sapiens
agggtacagtgtggtcttttgatatgtatatatattgtagaaagattaaatcaagctgataaatatatatccatcacttcaccttcttatcattttttttkgtgatgagaatatttaaaatctattcttctgtgttccttcagtttttgtttcatcttcatgaaaaccttagaggcaggtggcatagctatcactacctct

SEQ ID NO: 70888 - DNA, 201 bp, Homo sapiens
atattgtagaaagattaaatcaagctgataaatatatatccatcacttcaccttcttatcatttttttttgtgatgagaatatttaaaatctattcttctrtgttccttcagtttttgtttcatcttcatgaaaaccttagaggcaggtggcatagctatcactacctctattgttacagataaggacaccagacataggg

SEQ ID NO: 70889 - DNA, 201 bp, Homo sapiens
ctttccttccacctcacactgcttattgactggagttccccctacattacaaagcacctaataagatgatcttttcctatcagcattaaaaatttttttttcgactttgtagaaaataatcgttttgcagcacttaaagagaatcacttgcgggcattctgtaaaattttacattttactgacagcacaaaacaggaaatt

SEQ ID NO: 70890 - DNA, 201 bp, Homo sapiens
cttttatcggataacaggctttgctgtgttatgtgatgggattaaactgtttatttaggatgtagaattgaagacgtggatgatgtgttattttttttccyaaagtgctctgtattttcttcagccagagtgtatttcagaacttcataatgaccttttataatttgtaaaatggtgtctaatgtttaggtccttttggga

SEQ ID NO: 70891 - DNA, 201 bp, Homo sapiens
aataatgtcacccaagtcttgaggaatttgctaattgtttgtagatcctacaaggtcataatctagacctgttttaaaaaatcttttaaaacttcaatatrtttatttgaaagggatgaagaaatgatatacattctacccagtctgcaggattacttgacacttgccgtcataggctgggactcaagaagtattagaggc

SEQ ID NO: 70892 - DNA, 201 bp, Homo sapiens
ttcttttaggtgtgtattttgtgaatgcatacgattgcatcgactggtctgattttatcagcagtgactagtctgtctacttctactttgtattcagagasattacctataagcagagttggtagcttcctaccaatatagttccatggatgcttggcaggccccttagcctaataatatgcctctcttctgattcctagt

SEQ ID NO: 70893 - DNA, 201 bp, Homo sapiens
gcacttgtgttctagattatagctattgcttcttaactggtctttctgcttccactcttgctgtcagtagttccagttttaaaatacagacctgatcatgrtgtttctttgattaaggtcttgttttctccagccccttcctgctcacagaggttagttgatcctctctggttcccatggtgcccagagcttaccagcact

SEQ ID NO: 70894 - DNA, 201 bp, Homo sapiens
taggagcaggtgaaggtgttgctatgcctggggctgatgaagtaggggaaaggggtgggtgagggaaactgctaaatgcccacataattctgagatatttyagcttcgctggttcatggtatagtcatgtgccacataatgatgttttggtcaacatgcatacatgacagtggtcccataagataataatggagctgaaaa

SEQ ID NO: 70895 - DNA, 201 bp, Homo sapiens
gggaagtgagcggagggcatgcaactcagccccttctgccttgtacccaggtttccagggctgcagtgccaggcaggcgtagcgtgggctgacgccatggrgagggctccactccccttctcccctttcttcccattcagatccattagagggacattaagcggcttagctgctgtgcaaacacaaagatcattctttttt

SEQ ID NO: 70896 - DNA, 201 bp, Homo sapiens
tgcagctctcccattctcagcttggcatggtgtaggccttaatacttgtgaactactgaagctatgtttctatgtcttttaaaaaaatatcttctagtggyagtgattgaaaaacagacagtggttcttattagcaacaacagtgcttcagaaatttgagtggaatgctgaatttggtattggatcagatgggtgacagga

SEQ ID NO: 70897 - DNA, 201 bp, Homo sapiens
tagaaatgaaaatataatgttaagtggacattcttggagttagaccttccttgatcctttaaacaggatcctggcccttacatctattttcccttcatcaytctatagcttttttaaagctttgcaccatccctctagtgagaacaacatcagtttttcaaaccagtcagagaaaagttgttatatgtttctctagaatag

SEQ ID NO: 70898 - DNA, 201 bp, Homo sapiens
ttgaaatgaaaccagatagaatttgtagaaatgaaaatataatgttaagtggacattcttggagttagaccttccttgatcctttaaacaggatcctggcmcttacatctattttcccttcatcattctatagcttttttaaagctttgcaccatccctctagtgagaacaacatcagtttttcaaaccagtcagagaaaa

SEQ ID NO: 70899 - DNA, 201 bp, Homo sapiens
ttggtggcgagacaaagtctcacagtgctgattgcctgtataggggccaaggaacttcctggaggaaaggcagtccaactctagctcctttctcttttttsgctcagttttactcgaacctctctgatggattgatgttgtcccagcagaggtcccttggaaagaaaggactccaaggggcccaaagggaaactcactatg

SEQ ID NO: 70900 - DNA, 201 bp, Homo sapiens
gggcctttctaggctcatgaaggagggcttgtggctgagcctgggtttctggcacagtatcgatcctttgacagtgtatatgagttaaggtaaagcagcartcccctgggatcccaagtgtgaggcatcacagttgtctttgcagggatctggaacaccagggtttgtggcagcaatggacaaaagtaacaactctatggt

SEQ ID NO: 70901 - DNA, 201 bp, Homo sapiens
ataaatgtggttgagtcaatgtggttaagtcagaatagtttgaggaactctaggaatgtggctcagagatgaaggaggtgttggtctttgtgaaaagggcrgataagaagtcttcttttccttatgggctcactgattgtgatgttctcatatagatgctctggcccagcacttaactttatggcaatgttttaaaagcag

SEQ ID NO: 70902 - DNA, 201 bp, Homo sapiens
ttctggcacagtatcgatcctttgacagtgtatatgagttaaggtaaagcagcagtcccctgggatcccaagtgtgaggcatcacagttgtctttgcaggkatctggaacaccagggtttgtggcagcaatggacaaaagtaacaactctatggttttaccaggagctgcagcagctagaaatgtggactcatcttggact

SEQ ID NO: 70903 - DNA, 201 bp, Homo sapiens
tatttggttattttgcactgaaaattaaatctaaaatgatttaatgatgagaatggtaactttgagagatttttgcattattcactttggagcaggaatayttagatacgtgggcttcatgactgtattttgggtttttaagtcagaaaactaggaaggtttataaaaacctttggaaaatatctgttgcatgctaaacta

SEQ ID NO: 70904 - DNA, 201 bp, Homo sapiens
cattttgtacatacgagctccttctacagttttctaagttgggtttcaaccatgttgttctgctgcttagccatgtagctctcttttgagatttttaaagrcaattgtttttaggcccagcgtggtggctcacgcatgtaatctctgcactttgggaggccaaggcgggaggatcacttggggctaggagtttgagataac

SEQ ID NO: 70905 - DNA, 201 bp, Homo sapiens
gactatatttttaccccacagttatgaagggagtcatataagtgtattcttcctccttaatgtctttcaaatcctttatctctgtcttaccacattaactsctccttctgcaactagtctcctcagtccatttccacactgctgcaagaatgatctttccagaatgcaaatatgatatgtcactcccctgattaacatcct

SEQ ID NO: 70906 - DNA, 201 bp, Homo sapiens
caacattaaagcctaatacatgggtactgaccttctacctaaaaggctggttttgaatgagtgattttcagtatgagaaatgaatgactcaagaaaagccrtatcagaagaagaaaggtagaaaatgataatggactcaaatgattctccatttgcttctaacattttctttttgaggacttcagtgatttatgccatttg

SEQ ID NO: 70907 - DNA, 201 bp, Homo sapiens
ttagttttgttaactggacagctcttgttaccctttttgctaatatttttagctaattatgtcagcaaaaacttgggttaaatgttaaaattatagtgtartcatagtttcccattccattggaatggtctgacatgtaatgtacagagagcatgcagaatgtctggagtgtatcgtgggacacagctaaagcctgggtga

SEQ ID NO: 70908 - DNA, 201 bp, Homo sapiens
ctagggacacagagattcagagcgtagttttttttgctataagtctaaaagcagtgcatgtgcagtgatccctgtggcccacgggggaggagggtgtgccygtccagtgggaggtaacactcaatgtctgctgcatggaaatcccaggccaggcctgcctggatcctccagtttttcaagggaagctagaaattcagattt

SEQ ID NO: 70909 - DNA, 201 bp, Homo sapiens
atttttttttcagatgagatgtgttcagtaagcacatacctcattagagagatggcaatggatggctgactacagtcatttcttttctttacccttaaacyacatgtaacccagaattgaaacatatacttgtattgaggttttccaaaacaattagtgatagagatcttaagaaggaccagaattcctggagggtgttgt

SEQ ID NO: 70910 - DNA, 201 bp, Homo sapiens
gactgcagattgtggtggagagttgaacatgtggtgcagagaaaacacaaaacctacagagggctgagagcagatgggctggaggagacagtctctctgtkgggaggggaaaggtgcttctttgagaaagggctgactctctctctttaaggtctttcctgtctcccttgggctgtgttaacttctgaagtgattttcatc

SEQ ID NO: 70911 - DNA, 201 bp, Homo sapiens
attgctgttgctttatattaaattttaaaatcagcttatatgatttttccaatcttatttttcctttatcaaaattgttttggttattccagttcttctgkcttttcatataaattttagaatcagcttgtctgtacctacagaaaatcatgctgggatttttattgggattgcataaatttatagataagtttggtgaga

SEQ ID NO: 70912 - DNA, 201 bp, Homo sapiens
ctgtgaataacatagaaataaataaatgaccaaagcacagggttctgattaggagactctccctagaaagcacatctcaactcagactatccacttttcawccattctgtagccacatgtggcaagtggctgtcgtattagacctttgactgcccatcccagtgtgagctcaaggagcaggcccgtctgccttatcccaga

SEQ ID NO: 70913 - DNA, 201 bp, Homo sapiens
ttttcggaaactgttttttttttgaaattatttttaggtcgatactgcaagcaacttgaactctggtaaagaggaccactccgaaagcagtaatacagagracagaagaactagtaatgatgataagcaggaaagctgctctgagaaaataaaattggctgaagagggatcagatgaagatctggatttggttcaacatca

SEQ ID NO: 70914 - DNA, 201 bp, Homo sapiens
cagtttttcttatcctcttatttaagagttagcttcaggttgggtgggtggttcatgcatgtaatcccagcgctttgggaagtggagtcaggaggattgcstgaagccaggagttcgagaccaacctgggctacttagcaagaccttgtctatacaaaatatttaaaaattagccaagcatcaggaggctgaggtgggagg

SEQ ID NO: 70915 - DNA, 201 bp, Homo sapiens
ccccttacctaaatgtgagattagctctctggtgcagtgtgtcctccatagcttccccagggatcagactgaagctgagcttcagctgagaccacatcctygcttggccctgtgcccttgccctcggctgttttcctcatgtccctggtcccaaaggcactctcccagtgaattacttgaacaagaatccttgtcttagtt

SEQ ID NO: 70916 - DNA, 201 bp, Homo sapiens
acctagaaaatgtaaaatgcctaatcttgcaacttttctttgtgtatctgtagtgtagaagtctcagattccattttttttttcctgaactgtgaatttcyttgagtatatgatattttccattaataaattctgtagttggccaaggaatcaagaaacccagtggttatggttgacagagagaagaaaaggctggttgag

SEQ ID NO: 70917 - DNA, 201 bp, Homo sapiens
ttggtataaaataaaattacctagaaaatgtaaaatgcctaatcttgcaacttttctttgtgtatctgtagtgtagaagtctcagattccattttttttttcctgaactgtgaatttctttgagtatatgatattttccattaataaattctgtagttggccaaggaatcaagaaacccagtggttatggttgacagagag

SEQ ID NO: 70918 - DNA, 201 bp, Homo sapiens
gatgaggatgtttggtaaggatgacactcagcgggctctttctaaatcgtagggaattgtctacacattatatgtaattttacataagcaaagtttgaaartgtgttttaggtatctaatgtcatagaaggacttccttcattttctacttgactaggtttccatagtagggtggagataatgctcctgattctggataca

SEQ ID NO: 70919 - DNA, 201 bp, Homo sapiens
gccctactcccagatgtgtaactaaacttagatcccagaatgcctcaagacaccaatgacaaagtcaaaggtaggaggtgatagcttatggtgctaaaaakttgcaagactttcccaattgatactggaaaatattctgggggaatatgtatgataatggattttgaaagttttaggtcaaatagagaaaaataccacttt

SEQ ID NO: 70920 - DNA, 201 bp, Homo sapiens
ttttttgtgagaaacattaaacttgtaaaatgttcacaactgctcctatttaaaaaagttctgtgtgggcaaacaaaatatccctcccttccaccaaaaarcaaaaacatatctacagaatatcacacataataatcctctaaataatccttcctgagatggtgaggtcccagcgggggctgtgtctaggagcaggtgaag

SEQ ID NO: 70921 - DNA, 201 bp, Homo sapiens
agcttccactcctgcaagctccactcatggttaagtgccctttacaggtatgccattaaaaagatttttataccatattttattgtaccttttctatgttktaatatgtttagattcacaaatacttcctattgtgttaacaatcacctacaacacagtaactacaaaacatactgtacaggtttatagcctaggagcaat

SEQ ID NO: 70922 - DNA, 201 bp, Homo sapiens
taaagcataggtttatttgcctatataagctataagcttatataacttaataacttaagttataagcttatataacttaaatttgagtaaaatttttttttactcaaagctacttctgtttgaaaagaattttaatcaagagatcttactctttctctcgttctttccagctattttcatcaaaaaaattttaaatggtta

SEQ ID NO: 70923 - DNA, 201 bp, Homo sapiens
aaaagcttacaaagaaagaaaatatttttgtacagttctatactgtgtttatgttttaagctaagtgttattataagagagcgaaaaagttaaacaaattyaaaagttttaaaagtaaaaaagttacagtaaaaattcctttattattaaataaagaaaaatattttaaaataaatttagtgtagcctaagtttacagtgt

SEQ ID NO: 70924 - DNA, 201 bp, Homo sapiens
tgttctccttcaagccacaggctggccagctgtggggaactgtgtgtgtgtgtgtgtgtgtgtgtgtgtgtgtgactgagggggagagagagagagagagmgacagacagacagacagacagactacttcagcctctgtctccctgtaagcatgccacactgcctttgcttgtctgcagctgtcatgggtggttggagagc

SEQ ID NO: 70925 - DNA, 201 bp, Homo sapiens
atatgtctgtttaatatatttaaagaaataaaatgagctttgagaatatgacaaagatttgaaatgaaaccagatagaatttgtagaaatgaaaatataaygttaagtggacattcttggagttagaccttccttgatcctttaaacaggatcctggcccttacatctattttcccttcatcattctatagcttttttaaa

SEQ ID NO: 70926 - DNA, 201 bp, Homo sapiens
cgtattagacctttgactgcccatcccagtgtgagctcaaggagcaggcccgtctgccttatcccagagcccggcagatagcagttcccttcaggactgaygtagactcttctccattattgctagggattgctggagaatggtgcaaatgttattacatggaattgtgtagttaaattacatttaattagagtgttatat

SEQ ID NO: 70927 - DNA, 201 bp, Homo sapiens
tctgttctccttcaagccacaggctggccagctgtggggaactgtgtgtgtgtgtgtgtgtgtgtgtgtgtgtgtgactgagggggagagagagagagagmgagacagacagacagacagacagactacttcagcctctgtctccctgtaagcatgccacactgcctttgcttgtctgcagctgtcatgggtggttggaga

SEQ ID NO: 70928 - DNA, 201 bp, Homo sapiens
tggggacatatataactgtctctgctttggttgtgggaggaatggaaaagagaagtcccccatgagagttaccaacgataagcctgcatgaaggtaggctytgggtttgagttcataccacctgtagggccaagttgaatgttcagttgaaaatggtcttggattggcagtaatcccagctcctggtagaaggaaagggaa

SEQ ID NO: 70929 - DNA, 201 bp, Homo sapiens
tagttaaattacatttaattagagtgttatatttctagaatactttaatgctagtgtatgcatttatgtacattctccatctgcttccattagtgtcaaartattctagaaatgtaaagtttaaaaaaagacagtattttcggaaactgttttttttttgaaattatttttaggtcgatactgcaagcaacttgaactctg

SEQ ID NO: 70930 - DNA, 201 bp, Homo sapiens
ttcttcacaggggcatgtgagagcttctgttctccttcaagccacaggctggccagctgtggggaactgtgtgtgtgtgtgtgtgtgtgtgtgtgtgtgtkactgagggggagagagagagagagagagacagacagacagacagacagactacttcagcctctgtctccctgtaagcatgccacactgcctttgcttgtc

SEQ ID NO: 70931 - DNA, 201 bp, Homo sapiens
tatttctagaatactttaatgctagtgtatgcatttatgtacattctccatctgcttccattagtgtcaaaatattctagaaatgtaaagtttaaaaaaaracagtattttcggaaactgttttttttttgaaattatttttaggtcgatactgcaagcaacttgaactctggtaaagaggaccactccgaaagcagtaat

SEQ ID NO: 70932 - DNA, 201 bp, Homo sapiens
cttcttcacaggggcatgtgagagcttctgttctccttcaagccacaggctggccagctgtggggaactgtgtgtgtgtgtgtgtgtgtgtgtgtgtgtgtgactgagggggagagagagagagagagagacagacagacagacagacagactacttcagcctctgtctccctgtaagcatgccacactgcctttgcttgt

SEQ ID NO: 70933 - DNA, 201 bp, Homo sapiens
tgaccattggaacaagcattggtccccgtggtatctgttaacctctaaaggcctaaagtgtgggttttaaccaggcatgtgtagggagcacaggaaacagmgcccaagacagggtaaaggtcaagtcagagctcccacatagagtcagcacaccaaatggttaaccccgagtggaaacactaggaagaatctgctctggag

SEQ ID NO: 70934 - DNA, 201 bp, Homo sapiens
tactagtctggcctatattaaattcatagatcatttactttttgcatcttctgtttcgttacggaggtaacacatgtataatctatataagaaaatattgrttaaacaaaaaaaattactatcagctaaattctcaacttgtagagataaccactattaatattttagtttactctttatcttttgagatgtgtttaatgc

SEQ ID NO: 70935 - DNA, 201 bp, Homo sapiens
gttctttcctgtgacttactcctctagtttcacaaatgtcatatattttgatatattgaggatgccaacaagtttttagaaattttatgatttttttatarttattttcaaaatgtctgctgtcccattgattaccaggatgctgtttcatttgtttttcattttttttccttctgtgtcttcttatcctccaatgaggta

SEQ ID NO: 70936 - DNA, 201 bp, Homo sapiens
ctgtctctgtgaatttgcctagtctgaacatttcatataaatggaatcatacggcatatggccttttgtgactggcttcttacattatgtcttcaagattyatccatgttgtagcatgtatccatactccactcttttctattgttgaataagtctcaattatatggatatatcacattttgcttatccattcatcatttg

SEQ ID NO: 70937 - DNA, 201 bp, Homo sapiens
agccacccatgttgattctaaaatgagggcctgaactttgcttttgtgctctagtggtgggtaatatgctgacaccacagctcagatgtagagaacaattyttgctttcctctctctggagaatgacaggaattaaaaaaacattttttttttcagtttgaattaggcatagaaaaattttgtatttgtaatgtgttagct

SEQ ID NO: 70938 - DNA, 201 bp, Homo sapiens
gcatttatgtacattctccatctgcttccattagtgtcaaaatattctagaaatgtaaagtttaaaaaaagacagtattttcggaaactgttttttttttdaaattatttttaggtcgatactgcaagcaacttgaactctggtaaagaggaccactccgaaagcagtaatacagagaacagaagaactagtaatgatgat

SEQ ID NO: 70939 - DNA, 201 bp, Homo sapiens
ttaagtctagagacacaatggtccagagatccctgtgaaagggagccctcatccggggagccccagcttgcacagtcaccccctcaccccttcctggggakcagtgagaatgccgtgggctgtgcctgcactgagaatgctgcttttctgtgaaaacacagtcaagtgcacatgataggttttagttcccaagcagtgtta

SEQ ID NO: 70940 - DNA, 201 bp, Homo sapiens
ttaggtgaggcaatgagtgtactcttttgaactagcctgttaaaagatacactctcacgttggttttcttatcatctctccttatttcactcagttcccccttcttccccctttatttttataatcccatcctcttgtctttttatattcatcagttctttcctgtgacttactcctctagtttcacaaatgtcatatatt

SEQ ID NO: 70941 - DNA, 201 bp, Homo sapiens
aaatggtcagtaatatttaagacataagtatctgcaaagaaagtgaattatggaaagtaaattacagtatatcatttgtataaaggagaaggtggttggaracttgtccaggaactatattgagaccattttatttgcatttctatataatatgcatgcctttcagctttccgttaaattttggcccccaaattattaaac

SEQ ID NO: 70942 - DNA, 201 bp, Homo sapiens
aatggaaggagggaaggagggaaggagggaaggagggaaggagggaaggagggaagcccaaacaggaaaaccattagggtctaacaggaaaatcactaatrtgtctagtgatgtacatgttaggtgaggcaatgagtgtactcttttgaactagcctgttaaaagatacactctcacgttggttttcttatcatctctcct

SEQ ID NO: 70943 - DNA, 201 bp, Homo sapiens
tcatttgtataaaggagaaggtggttggagacttgtccaggaactatattgagaccattttatttgcatttctatataatatgcatgcctttcagctttcmgttaaattttggcccccaaattattaaacttttatacttgcaactgggccccaacatttaaaaaaaatcctgtttgtgtctggacacacaattcattttg

SEQ ID NO: 70944 - DNA, 201 bp, Homo sapiens
gattcctggtgtgtaattttcttttttgtgttgggtctttgtgtggctcaggtatcaaggtgatactggcttcataaaatatgttagaaagtatcccctcyagcctggtttttttttttttggaagagtttaagaagtattggtattaattcttcttggagagtttggtggaattcagccatgaaaccatctggtcgtggg

SEQ ID NO: 70945 - DNA, 201 bp, Homo sapiens
cttcccctgtcagtttgtcggcgcaacaggtcagacaaatgcacaaggccttacaatatttgtcttgatgtctttggcttgtaaagctagattttaagatwttcagggttccttattccttagccgttagcgtttttggacttcttggctactgtaataattattctgaaccattctccatctttcttaaaagtttaatat

SEQ ID NO: 70946 - DNA, 201 bp, Homo sapiens
taaaaaccttttgctggcctatcagtgaatcaattctccactgtttaattttagtagcttttgtggtttggtttgtatggactatacagggaagcagactsaggctatgtgatttcagattgttttccaatagggatggaatgttttcatcagatgagcccagaattctgatacagttattgactttagggagtgataacg

SEQ ID NO: 70947 - DNA, 201 bp, Homo sapiens
caataggatgactgtcttcctatgagaatatgagaatccacctgtcttcccttcatccagatattacaaatttaaacaataccactcttctcactaatttktttgagaatatagttatttgttataaaatgtgatacttatgttaacataattagtaatagcatgttttttatttttgaaagtgaattaataagtaaatat

SEQ ID NO: 70948 - DNA, 201 bp, Homo sapiens
agagatggggtcttgccatcttgcccagtctggccttaaactcctgagctcaagagattcctcttggcctcccaagtgccaggattacaggtgtgagccaygccaggctctgtcattttattataacattgatgaaaaaaaaatggattcccagctagggccactgtctgtatggagtttgtcttccccctgtctgcatgt

SEQ ID NO: 70949 - DNA, 201 bp, Homo sapiens
ttggaaacaactgtatttgttttctagtgtatattattttaaaatattttagaatatttttgtaaggtatgtttcccgattacattactctaaatacgaaygtttttatatttccaataaaatattcactaatatttacctttccaatgagatattttacttgcatgactatttttaaagtatgtgctcattttggtggag

SEQ ID NO: 70950 - DNA, 201 bp, Homo sapiens
tggtggaaggctctatgccaccccctcatcacgaccccagtcttcttcacaggggcatgtgagagcttctgttctccttcaagccacaggctggccagctrtggggaactgtgtgtgtgtgtgtgtgtgtgtgtgtgtgtgtgactgagggggagagagagagagagagagacagacagacagacagacagactacttcag

SEQ ID NO: 70951 - DNA, 201 bp, Homo sapiens
agatctatctatatttttgtatgcagtggtgcacccttttttaggactgtataacattccatagtgagaatgtacctaaatttatttctgcattttctcaratagacatttgggttattttcagattttcgttatgaatgctactgtgataaacattcttgtacatgttatctgctctacatgtacaaaatttcctctagt

SEQ ID NO: 70952 - DNA, 201 bp, Homo sapiens
ccaatctgtattccctcaaacagtatacaagggttcccttttctccacaccctcaccaatagttgttatctcctgtctttttgataatagctttcctaacragttgttatctcacagtagggttgatttacatttccctgatgattagtgatgttgagcaccttttcatattgttggtcatttttatgttttctttgaaaa

SEQ ID NO: 70953 - DNA, 201 bp, Homo sapiens
aatgaataattgaacattataatgaaaaattttggcaagttaatgaattcatactcattttttttttgtttgtagactagattctgcattatggaactctwagaattctgtctgtcatgatgtggttcaggaatagcattctatgtatttcaagcagaaggggattgaatacaagagttaaagcctgggcaacattgtgag

SEQ ID NO: 70954 - DNA, 201 bp, Homo sapiens
ctgtctgcatgtgttttctccagacactccagtttcctctccatctcaaagatatgcatgttaggttatctacgtggttccactgtgagtgagtgtgggtktgtctgagggcaccctgccatggcatcctgtccagggtgtgttcccacctgggactctgagctgcacagatagactctggccacttgagactctgaatta

SEQ ID NO: 70955 - DNA, 201 bp, Homo sapiens
ctctgtgctaggtatgggaacacagagatgaggaggacctggtgccagcccgaggagcttacatccagcagggaaagtagatgcagagggtactgggatgrcacagcctgatgccccaggtttgggagacacagagggcagccgccacccactggtgagggattcttgtttatacacttgcctcagatttatgagttgaga

SEQ ID NO: 70956 - DNA, 201 bp, Homo sapiens
ggatttttttgcttacttatacagctggttactatgcgatgagaggcaaatgacaggcatccagggaagtcgtgtgtttttacccattggtgaaattgacrgtcaccagccacccatgttgattctaaaatgagggcctgaactttgcttttgtgctctagtggtgggtaatatgctgacaccacagctcagatgtagaga

SEQ ID NO: 70957 - DNA, 201 bp, Homo sapiens
ttttggattccacatataagtgagatcatgatcatgcggtatttttctttctgtgtctggcttatttcacatagtattatgtcctccaagtctacccatgytgtggcaaaaggcaggttctccttttttaaggctgagtaatattcctgtgtgtgtgtgtgtgtgtgtgtgtgtgtgtgtgtttatgtattacagttgctt

SEQ ID NO: 70958 - DNA, 201 bp, Homo sapiens
ttattattcagttctattttcacagcagaccaaattaaacctctatgtcagacttgtagtgaatatcacagcagtaggcccagaatgcaggctttttattrcgcttgggcatttttgcaaatctgaagcattttttccatggtgagtggacatgaagtctgggaagaggtgtcttcgttacttcgcctctgcctgtaggtg

SEQ ID NO: 70959 - DNA, 201 bp, Homo sapiens
ataaacagtttcgaggatttttttgcttacttatacagctggttactatgcgatgagaggcaaatgacaggcatccagggaagtcgtgtgtttttacccaytggtgaaattgacggtcaccagccacccatgttgattctaaaatgagggcctgaactttgcttttgtgctctagtggtgggtaatatgctgacaccacag

SEQ ID NO: 70960 - DNA, 201 bp, Homo sapiens
ggaagattattcttttaatttagtaccagatttaaatgaatgaatttattcagattttttgcatctatatttataagcaaggttagttgtgtttgtgtgtgcacacacaggtgtgtgaaatgtttgttatggtatagggggtgaagttgagggtggagagtcgatgtatgtgtgtttgctttgtcaggctgtgtgaacttc

SEQ ID NO: 70961 - DNA, 201 bp, Homo sapiens
gtgtcttgtcgtgatcctcccctgccaagactcacacactgtttggtttcactgaaatggactgtgaatgccagggtcaagaggataaaaatataaaagtytttgtgcataaagtttttacctataatgcctctgattatcacctagggcttagttcctggtattaacatcgtgaaatcaaaatgtatgaaataagtttct

SEQ ID NO: 70962 - DNA, 201 bp, Homo sapiens
tgattgatttacataagttaaaccacccttacctgccagggataaatcccacttgatcatgatgtgtagtctttttgatatattgttgaatttggtttggkaatattttattaaggatttttacatcaatgttcatcagagattcctggtgtgtaattttcttttttgtgttgggtctttgtgtggctcaggtatcaaggt

SEQ ID NO: 70963 - DNA, 201 bp, Homo sapiens
aaccaggtttgtacaccgggcagatgtccaggcagccataaacatggctttaggaacagcctggttaggggctggctgctgtggctccgcagccaccagaygtttgctttccacgagatgctcattgctgccaccatcactgtccctgttaatcatttccctgcacctttgcttctgtccctcaaggtttggggtgtttgc

SEQ ID NO: 70964 - DNA, 201 bp, Homo sapiens
ttgtcagattgctcttgctggtccttccagtactgtgttgaatagaagtgatgagagtgggcatccctaccttgtactagatctcagaggaaaagctttcygtttttcccccttggttatgatgttaactgtgaactttttataaatggccttcaggaaattttcttctatacctaaactcttgagagtttttatcaagaa

SEQ ID NO: 70965 - DNA, 201 bp, Homo sapiens
gatgctatcataaatgagattgttttcttgatttttttaggctaggttgtttgtgtatagaaatgccacagattttcatatgttgattttgtactctacarcttttctgaatttatttattacttctaatagtttttttctggtggaatctgtgaggttttctacatacaaaatcatgtcatctgcaagtagagataattt

SEQ ID NO: 70966 - DNA, 201 bp, Homo sapiens
gcaaattttagagtagcatagaattagtattcctgcttatttatttctgggtgacaatttttttaagcagcaacttcatgatattgataacttacacataytttaatacacagattaatattacttcattcaagacttattaaaaggagaatatcagtgatcacgtaaactcagattttatttgaacctactaagctacag

SEQ ID NO: 70967 - DNA, 201 bp, Homo sapiens
ggtatatctagaaacacactttgtgaatgtgaaaggttctcttgtacccaactagaaataatcactgactgcctctgaagataatgatggagaatttgttraaagatttctctttaattataaagtggctatgcaaatgtgattacagtttaaatttattttcgtagtgaaaatagcttttgggggcattcaggcattcta

SEQ ID NO: 70968 - DNA, 201 bp, Homo sapiens
tcctccaagtctacccatgttgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggagt

SEQ ID NO: 70969 - DNA, 201 bp, Homo sapiens
tttcattctattcctttgcagataatcccatgtcacccttaatcccttacaattactgatctattccctgtctctcttctttttccttttccagaagtttrtataaatggaatcatacagtatgtagcttttcacgctggcttttatctcctagcatacttaatacatttgagattcatccatgttaatacatgtggctga

SEQ ID NO: 70970 - DNA, 201 bp, Homo sapiens
gtatctaatacatggaatgaggtttcaggccctgcctccactgaggcgcttcccactgggaagtactagagaatatttttaaagagtctctgtggacacasagcaagttttaggtttttttgtttttgtttttgtttggtatatctagaaacacactttgtgaatgtgaaaggttctcttgtacccaactagaaataatca

SEQ ID NO: 70971 - DNA, 201 bp, Homo sapiens
gtcctccaagtctacccatgttgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggag

SEQ ID NO: 70972 - DNA, 201 bp, Homo sapiens
tgtatatgtgtgtatatgaaggagtcatggggtgatatttttctggaacctgagaagaaaacttggtctgcaacattcagatttcaagcactgcgctggcrtgttcatctccccagggacaggcccagggtaccatgtctcttaccagcagcaggctggtaaagtgctgggcccctccatctctggaataggaaggggtgt

SEQ ID NO: 70973 - DNA, 201 bp, Homo sapiens
gggaggctgaggcaagaggatagcttgatttcaggagttcaaggctgcaatgagttgtgattgtgccactgcactgcagcttgggtgacagagtgaaactstgttccccctccacctcccccactgcaaaaaagagtttagttcctcaaaatcaacagaagacctcaaaatcaacaggtgaccagcaagaaagggagttca

SEQ ID NO: 70974 - DNA, 201 bp, Homo sapiens
ctgcttagataagtaggatccaagattaagaaaaaaaatggaaagaaatgtttaggtagatgaaatcttttgattaatcacccgaaatgtgcaaaatctayagcaaatttttatttcaacagctcttagtcctatatatataagttgaacttgcttctataaatacagatgcaagttcaaaatataactaacaaagtactg

SEQ ID NO: 70975 - DNA, 201 bp, Homo sapiens
gtggttcatgcatgtaatcccagcgctttgggaagtggagtcaggaggattgcctgaagccaggagttcgagaccaacctgggctacttagcaagaccttrtctatacaaaatatttaaaaattagccaagcatcaggaggctgaggtgggaggattgcttgagtccacgagtttgagactgcagtcatgccattgctctg

SEQ ID NO: 70976 - DNA, 201 bp, Homo sapiens
cccagtccagtctgcttggtgtcgacaaacatctttttagggttcaaacctattcatgtcttcccctctctgtgtacagatgttttcatctggcattcagmgccctttgaaatacacacagctgccctttcagcctcatctaatcaatagttgccattctagttatgtgattctatattgaattcttcctgaacacttctt

SEQ ID NO: 70977 - DNA, 201 bp, Homo sapiens
cccaggagtttaaaaccagcctgggcaccatagtgagacccccatctctacaaaaatttttttaaaaaattatccaggtatggtgacatgcacctgtagtmctggctctggctgttcagaagctgatgtgggaggattgcttgagcccaggcgttcgaggttgcagtgagctatgatcatgccaccacacttcagcctgag

SEQ ID NO: 70978 - DNA, 201 bp, Homo sapiens
atgagtgcaaggttttattgagtggtagaggtagctctcagtgagatggatggggagctggaacggggatggagtgggaaggtggtcttcccctggagtcrggctgcccagtggctgaactgtcctctgactgcctctggctgaactcaccttcgcatctgcatcgttccgtagtcactggtttgccagtgtctgctggtg

SEQ ID NO: 70979 - DNA, 201 bp, Homo sapiens
cagaccatgtgatcacacgcctaatgatgtccgagttggagaataggcgtggccagcactggctccttgatggttttcctaggacattaggacaagccgargccctggacaaaatctgtgaagtggatctagtgatcagtttgaatattccatttgaaacacttaaagatcgtctcagccgccgttggattcaccctccta

SEQ ID NO: 70980 - DNA, 201 bp, Homo sapiens
agaacatcaaggccagcaccgaagttggtgagatggcaaagcagtatatagagaaaagtcttttggttccagaccatgtgatcacacgcctaatgatgtcygagttggagaataggcgtggccagcactggctccttgatggttttcctaggacattaggacaagccgaagccctggacaaaatctgtgaagtggatctag

SEQ ID NO: 70981 - DNA, 201 bp, Homo sapiens
tttttggaaacaggaaaatcttcaaacttctttcttcacttccctttgtgtttagctgaccctccaatgtgatcattgcctttggagtttgggagaggtaygggaagtggcctgatgcctgcttccatacttcactcctccatccatccttccctccctcttcccctccagctaaatggacaattctagccaacattgagt

SEQ ID NO: 70982 - DNA, 201 bp, Homo sapiens
tccccatccatcctctcaaacataatgagattgtttactttttagatttatgcagtgaaaatgcccagtcaggtctgaatcgtcagtgcattatattgacyctgagcactttagaatttagagttgcaattgaatgccagctgtggagatggggtgcatatcagatatataaataaagctcaggtttgctagggaaccagg

SEQ ID NO: 70983 - DNA, 201 bp, Homo sapiens
tccggaacggagacgaacaaaatctggccctacgtttacacacttttctcaaacaagatcacacctattcagtccaaagaagcatattgaccctgcccaawggaagaaccaggaagatgtggtcattcattcaatagtgtgtgtagtattggtgctgtgtccaaattagaagctagctgaggtagcttgcagcatcttttc

SEQ ID NO: 70984 - DNA, 201 bp, Homo sapiens
cacatccctaatgtaggtcctattatcaccattctcattttgcaggtgaggagactgaagcatgagattaagaaatcaagaccgccttccccctgtagggscggccggcgagtcccagtgagagcggagggtgccagaggtagggggccgagaaacaaagttcctggggctccctccggggccgcggtcggggctgcgcgt

SEQ ID NO: 70985 - DNA, 201 bp, Homo sapiens
agattaagaaatcaagaccgccttccccctgtaggggcggccggcgagtcccagtgagagcggagggtgccagaggtagggggccgagaaacaaagttccyggggctccctccggggccgcggtcggggctgcgcgtttgaccgcccccctcctcgcgaaggcaatggcttccaaactcctgcgcgcggtcatcctcgggc

SEQ ID NO: 70986 - DNA, 201 bp, Homo sapiens
gagtgatggggctatattgaatctctgtatgcactgagaactgagctatgaagaggatcttattaaactgctggtctgactttatggattgacactgttcmtttcttttattgtgaaaaaaaaaaaaaaccctgaaagtcttgggaaccccctaaagtcttttgggaatcctcaaaaagcatgggaagttaagtatttagc

SEQ ID NO: 70987 - DNA, 201 bp, Homo sapiens
aagttggtgagatggcaaagcagtatatagagaaaagtcttttggttccagaccatgtgatcacacgcctaatgatgtccgagttggagaataggcgtggmcagcactggctccttgatggttttcctaggacattaggacaagccgaagccctggacaaaatctgtgaagtggatctagtgatcagtttgaatattccat

SEQ ID NO: 70988 - DNA, 201 bp, Homo sapiens
caccgtgtgccagaggatcgcccagaactttggtctccagcatctctccagcggccacttcttgcgggagaacatcaaggccagcaccgaagttggtgagrtggcaaagcagtatatagagaaaagtcttttggttccagaccatgtgatcacacgcctaatgatgtccgagttggagaataggcgtggccagcactggct

SEQ ID NO: 70989 - DNA, 201 bp, Homo sapiens
gtttctctggtcttgagtgactgtgtccacagttcatttttttccggtaggaataactccttttctacatccacactccatagagtctctccttttcagayatcctgggatgaaagaatttggcttttttttttttttttttttgacatctgttttcactcttaggcttttaaacaatagttattgctcttatccctctca

SEQ ID NO: 70990 - DNA, 201 bp, Homo sapiens
aaacacttaaagatcgtctcagccgccgttggattcaccctcctagcggaagggtatataacctggacttcaatccacctcatgtacatggtattgatgaygtcactggtgaaccattagtccagcaggaggatgataaacccgaagcagttgctgccaggctaagacagtacaaagacgcggcaaagccagtcattgaat

SEQ ID NO: 70991 - DNA, 201 bp, Homo sapiens
ccattagtccagcaggaggatgataaacccgaagcagttgctgccaggctaagacagtacaaagacgcggcaaagccagtcattgaattatacaagagccraggagtgctccaccaattttccggaacggagacgaacaaaatctggccctacgtttacacacttttctcaaacaagatcacacctattcagtccaaagaa

SEQ ID NO: 70992 - DNA, 201 bp, Homo sapiens
gtctcagccgccgttggattcaccctcctagcggaagggtatataacctggacttcaatccacctcatgtacatggtattgatgacgtcactggtgaaccrttagtccagcaggaggatgataaacccgaagcagttgctgccaggctaagacagtacaaagacgcggcaaagccagtcattgaattatacaagagccgag

SEQ ID NO: 70993 - DNA, 201 bp, Homo sapiens
gtatcccttcttcacccatcatgactgtccccagtgagtgtcctttactattcttgggagtgactcctgtctaacttttcatactggcgagaagaaaagargcctattttaacactttagtggtgttgaaacacattacttactttctgaagatgtcccagtgaatcctctgtcaattcactgccatatgtaatctatatg

SEQ ID NO: 70994 - DNA, 201 bp, Homo sapiens
tatagatcagtcttctccccatccatcctctcaaacataatgagattgtttactttttagatttatgcagtgaaaatgcccagtcaggtctgaatcgtcartgcattatattgactctgagcactttagaatttagagttgcaattgaatgccagctgtggagatggggtgcatatcagatatataaataaagctcaggtt

SEQ ID NO: 70995 - DNA, 201 bp, Homo sapiens
ccgaagcagttgctgccaggctaagacagtacaaagacgcggcaaagccagtcattgaattatacaagagccgaggagtgctccaccaattttccggaacrgagacgaacaaaatctggccctacgtttacacacttttctcaaacaagatcacacctattcagtccaaagaagcatattgaccctgcccaatggaagaac

SEQ ID NO: 70996 - DNA, 201 bp, Homo sapiens
attacttactttctgaagatgtcccagtgaatcctctgtcaattcactgccatatgtaatctatatgataaggaatgcatcttccaagtactgcccaaacycttgccagctcctctcccattgtcccttcatgtgaatatttcttggctaccttagtggaaatatagatcagtcttctccccatccatcctctcaaacata

SEQ ID NO: 70997 - DNA, 201 bp, Homo sapiens
tatcagatatataaataaagctcaggtttgctagggaaccaggtatagagaaaaataagtctgatatgaggaaaattgcacaatttagagtagttatgccrtagagaaaatttccacaaactaggaaatgtagagagttattctatagaatactcaaaagaggaaagtatgtgatttttggaaacaggaaaatcttcaaac

SEQ ID NO: 70998 - DNA, 201 bp, Homo sapiens
ccctccaatgtgatcattgcctttggagtttgggagaggtacgggaagtggcctgatgcctgcttccatacttcactcctccatccatccttccctccctyttcccctccagctaaatggacaattctagccaacattgagtcactcaataagtctcaacagtgggtgtgtttgctgagattgtccagcagttgagcagtt

SEQ ID NO: 70999 - DNA, 201 bp, Homo sapiens; identical to SEQ ID NO: 38221

SEQ ID NO: 71000 - DNA, 201 bp, Homo sapiens; identical to SEQ ID NO: 38056

SEQ ID NO: 71001 - DNA, 201 bp, Homo sapiens; identical to SEQ ID NO: 39732

SEQ ID NO: 71002 - DNA, 201 bp, Homo sapiens; identical to SEQ ID NO: 38078

SEQ ID NO: 71003 - DNA, 201 bp, Homo sapiens; identical to SEQ ID NO: 39734

SEQ ID NO: 71004 - DNA, 201 bp, Homo sapiens; identical to SEQ ID NO: 39735

SEQ ID NO: 71005 - DNA, 201 bp, Homo sapiens; identical to SEQ ID NO: 43060

SEQ ID NO: 71006 - DNA, 201 bp, Homo sapiens; identical to SEQ ID NO: 42466

SEQ ID NO: 71007 - DNA, 201 bp, Homo sapiens; identical to SEQ ID NO: 39737

SEQ ID NO: 71008 - DNA, 201 bp, Homo sapiens; identical to SEQ ID NO: 39739

SEQ ID NO: 71009 - DNA, 201 bp, Homo sapiens; identical to SEQ ID NO: 39740

SEQ ID NO: 71010 - DNA, 201 bp, Homo sapiens; identical to SEQ ID NO: 42959

SEQ ID NO: 71011 - DNA, 201 bp, Homo sapiens; identical to SEQ ID NO: 40009

SEQ ID NO: 71012 - DNA, 201 bp, Homo sapiens; identical to SEQ ID NO: 38200

SEQ ID NO: 71013 - DNA, 201 bp, Homo sapiens; identical to SEQ ID NO: 38203

SEQ ID NO: 71014 - DNA, 201 bp, Homo sapiens; identical to SEQ ID NO: 38381

SEQ ID NO: 71015 - DNA, 201 bp, Homo sapiens; identical to SEQ ID NO: 38205

SEQ ID NO: 71016 - DNA, 201 bp, Homo sapiens; identical to SEQ ID NO: 40977

SEQ ID NO: 71017 - DNA, 201 bp, Homo sapiens; identical to SEQ ID NO: 42733

SEQ ID NO: 71018 - DNA, 201 bp, Homo sapiens
gtagcccattttgcctgtataagagccatggtatatatcctcctaccctagaaaccatggcaccctttcatattacccctataataggtccacaccgtaayataaactggatctaacttgtaaatcagtagttatgcccagtccttccagctcatttttcttattacagtctaaataattattccaattattctttttttt

SEQ ID NO: 71019 - DNA, 201 bp, Homo sapiens
gatattcccacgttggcttccaaagtgctgggattatagatatgagccactacacttggcctacaattctgctacaatttgacttctaagtctatacccarttgaattgaaactgggtactcaaatacttgtacatgaatgttcatagcagcattattcacattagccaaaggtagaaaaacccagacagatgtccatcaa

SEQ ID NO: 71020 - DNA, 201 bp, Homo sapiens
gggtgcctgtaatcccagctacttgggaggctgaggcaggagaatagcttgaacctggaaggcagaggttacagtgagccaagatctcctcactgcactcmagcctgggcaagagtgggcaggactctatctcaaaaaaaaaaaaaaaacaattatggaaaacaaaatttataaaaatctaaaagatatgtgatataaatg

SEQ ID NO: 71021 - DNA, 201 bp, Homo sapiens
ggttatctatttaaaatcatgctttatagtagtattatacagacatggaaaaatgttcagctacaggtcaacttgtcacgttcggtgactactacctcctytaaccctttgggtgtgttgcagcttcccaaggtggtttaccgtacctattggctttctttaatcctacttttttggtaaatattcccttcattaaatgct

SEQ ID NO: 71022 - DNA, 201 bp, Homo sapiens
catgccaccctgccctgtctgcccaggatgtgaattctgccttcgttcagcatatccatgctgtccatttagtagccttcttggttatcagagctattgtygcagggctactgcattcacataaccctgatattacttaacaattgcaccagagcacaagagtactgatgctggcatattgttacatgtattttttatttt

SEQ ID NO: 71023 - DNA, 201 bp, Homo sapiens
accatgttggccaggctgctctcaaactcctgagctcaagtaatctgcccgcctcggcctcccaaagtgctgagattacaggtgtgaaccaccacacccgkcccaagagtttttatagagcttaatccccatcccctattccctgccgtccctgacccccacctcgccaaaggtctgtggactgagctgaatgttctaacc

SEQ ID NO: 71024 - DNA, 201 bp, Homo sapiens
gtattttaagacccaagtggtttgcttcagggtttccctttaattaaagctggttccttgcttaaaggagaactcatttttttatttcatatttgtcttartcctgtattattctgtttcctcattattcattcattcattactaatcctacatgacatgtttatttttgccagatcactgtaatgaaacattaggacttt

SEQ ID NO: 71025 - DNA, 201 bp, Homo sapiens
ccaggccgggcgcggtggctcacgccggtaatcccagcactttgcgaggccaaggcaggtggatcacaaggtcaggagatcgagatcatcctggctaacayggtgaaaccctgtccgtactaaaaatacaaaaaaattagccgggcatggtggcgggcgcctgtagtcccagctattcaggaggctgaggcaggagaatgg

SEQ ID NO: 71026 - DNA, 201 bp, Homo sapiens
atgggaattgtgggagctacaattcaagatgagatttgggtggcgacacagtcaaaccatatcaatcattcttttaaaaagtaaaaatggtgttccatgaraaaagtaactagttcagttcacaaccctgaaagggtctcagactacagaatatgcagactacactttgggaaccactgctttatggtaaagaaaaattat

SEQ ID NO: 71027 - DNA, 201 bp, Homo sapiens
aagtgtttcccccttcttctatagccacccagctttgtcatggttgccatttaaatggtatgtctttgtccattcttttactttcaacataatttgaaccyatctttgattgagatttcctctacaataaccaataatatttttatgaccatgaataaaactgcatttatcttactagctgcttttttaaaaaattgtaaa

SEQ ID NO: 71028 - DNA, 201 bp, Homo sapiens
cccagccacatccattcattgatttttatggctactcttcccagttacattttatgcatctgtaagctttccttccttagcaaaattgcattcaaaaatgkgtaaaaatgagtaaatacagaatatcactacagagacttgtatcctcaggtttattgatttcacattgtgaaataaacagcaaaggtcttagttttcaag

SEQ ID NO: 71029 - DNA, 201 bp, Homo sapiens
ttgagattttcttaaaagatttcttattttgcctctgatgtagtgaaaaacggggtaagtatgctaactttcttgtatatgttggggggtacttattcaaytccatttcttgtccttacaagatttataaatgtggtatgtttatagtgtggatatatatgttgccactgcaaaggtggtgcatatgtatatatgtgcaaa

SEQ ID NO: 71030 - DNA, 201 bp, Homo sapiens
tcaatgctaggaaagcttatcaaaactactttcccaggaaaccatctatagagatttgcattctacttaatgttaacactatttttaattattttattgtsttaagttataactctcagagaattagctaagtcttggtatatacatggtttgtgctttactcttaaacatctttaaagtgctattattctatatctgttg

SEQ ID NO: 71031 - DNA, 201 bp, Homo sapiens
aaaaatgagtaaatacagaatatcactacagagacttgtatcctcaggtttattgatttcacattgtgaaataaacagcaaaggtcttagttttcaagtgraaactttttggtaatcacaaaattacctgacacataccacgcttaaaccaacccccaaatttagcatattcattttgccatgagccagtcttgagatttt

SEQ ID NO: 71032 - DNA, 201 bp, Homo sapiens
catcatgcattggcagttcggaaaatattggttctctgagttatatagatcttttaaatattgacacattttattatccaaaacaaaaatcagttgttaayataataactgatgtcattagaaaggtcctggatagctttcaagatcacagtggcagctacgaggcttccaaaattcacttgaaagctaaagctttatcac

SEQ ID NO: 71033 - DNA, 201 bp, Homo sapiens
actccttttggctatgttctttatgttggctacttaagctctcagggtcttaattcccgatttgtaaaatggcaatgaccaatcccttgggggcgggcagkggggtggtgggcagtggaaagagagagagagagaatattaaataacataatgtaggccaggcacagtggctcacgcctgtaatcccagcactttgggagg

SEQ ID NO: 71034 - DNA, 201 bp, Homo sapiens
ttacagtgtgcagactgctgatcctggcagcagtggcagcagtctggatggtgtatacttgattagcagcatcattgcagtctattccattagagaatgarccattaccatggacatctgtctgattctctgctgtgatttgttttcacagttcacagtcctaaagaggagtgtctgtaatccgctagtttgttttcttcc

SEQ ID NO: 71035 - DNA, 201 bp, Homo sapiens
tttgtgctttactcttaaacatctttaaagtgctattattctatatctgttggatgagtcattatttttgaaatgataatcctagcatgaactctgatctrtggtgttggattctgtttcttaaataactttaaaattaactgttttcccttgagatttccttctcctatgtaggtatttgagctattgttctaagtttac

SEQ ID NO: 71036 - DNA, 201 bp, Homo sapiens
tgagcggcatctatccaggctggtgggatggtggtaaaagaatttaccaagacagttgtaggtaaagaaaggcagatttttttttttttttttttttttttgagacggagtcttgctgtttcacccaggctggagcgcagtggcatgatcttggctcactgcaacctctgcctcccaggttcacgccattctcctgcctca

SEQ ID NO: 71037 - DNA, 201 bp, Homo sapiens
tagagcaactaatattggttgggatatccacccgtctccccaattgttttacagcttttaaagattataagttttagctgacttcttttcattttgtcttragaaatgagactgcctgtgccaactgtggggcctgagaatcaacaccacttatgtcaacctaactttttgctctaggaaatttttgcaaatcagtttatc

SEQ ID NO: 71038 - DNA, 201 bp, Homo sapiens
ggattacaggtgtgagccaccatgcctggcccacattttagaatattataaagtataagggtttgtttttttccctccagataaccaaaatgtccatatgyaattatcagaggaacctgcccccaatatttcaatgtaggttctttctatttttcctaagtgtcggctggtctgagaaataaagagaaagagtacaaagag

SEQ ID NO: 71039 - DNA, 201 bp, Homo sapiens
aaagtaagtgtactgtggtgccgttttaggaaacaatgacccctcccccacacaagcctttaaatgtgtgtgtgtgtgtgtgtgtgtgtgtgtgtgtgtgkacaagaacagagaaaaataagaaagaatatatgctacattggtgtagagagctaatggagggggaaggacaagagaggaaactgtgtaggaaaccaaaag

SEQ ID NO: 71040 - DNA, 201 bp, Homo sapiens
accgcacccagccctaatttttttttttttttactaactactctcataggtaatgcggaggcctacctttcatcacattttaatctgttgcttttaatttrttccattctgggaaattaaattattaatgttgctaaattatttataatttggaaatcaatttgattaaaggtctaaggacctttcctaaagattgacaag

SEQ ID NO: 71041 - DNA, 201 bp, Homo sapiens
ccagctacttaggaggtggaggcacgagaatcccttgagcctgggaggtagcagttgcaatgagctgagattgcaccactactccagcctgggtgacatasggagactctatcagaaagaaataaaaaatagggccaggtgcggtggctcatgcctgtaatcccagcactctgggaggccgaggcaggtggatcacctgag

SEQ ID NO: 71042 - DNA, 201 bp, Homo sapiens
ctggcaacagagcaagactctgtctcaaaaaaataaaaataaccaaaatatggaatcaacctaagtgcccatcaatggatgaatgaataaagaaaatgtgrtataatacatatatatgatggaatattattcagccattaaaaaataatgaaatctgctgggtacggtggctcatgcctgtattcccaacactttgggagg

SEQ ID NO: 71043 - DNA, 201 bp, Homo sapiens
tggagatatctggtggtttgcttgctttatgttacaggtggaggtgtattctaatgctttcctgccgtaaaagctataatttgagaattggaaaatttttkgggcttttttctttacccccgactcatagtacagctttgagaatataataatattaaaaaagctttccatgctgctgtagcaactcctgtgaaatgattt

SEQ ID NO: 71044 - DNA, 201 bp, Homo sapiens
cctgagtagctaggactacaggcacccactaccacatccagctaatttttgtattttttttagagacagggtttcaccatgttgcccaggctggtcttgamcctctgggctcaagcaatctgcccaccttggcctcccaaagatctaggattataagtgtgagccacagtgcccagcctacatgctagagcatgtgactaa

SEQ ID NO: 71045 - DNA, 201 bp, Homo sapiens
caggaaagacttgcccccatgattcaattacctcccaccgggtccctctcacgacacatgggaattgtgggagctacaattcaagatgagatttgggtggygacacagtcaaaccatatcaatcattcttttaaaaagtaaaaatggtgttccatgagaaaagtaactagttcagttcacaaccctgaaagggtctcagac

SEQ ID NO: 71046 - DNA, 201 bp, Homo sapiens
tctgtttcggccctactaagctgacatagggggtggaggcctggagaggggctggagtgatgagctccaaggcagagagccccaagcactagaaaaagatrgttaatcactctttgttctgctaaacagcccgtgagattagggcttaaccttcagcctctgattttaaaggttattaaatagcagagtagataatttcct

SEQ ID NO: 71047 - DNA, 201 bp, Homo sapiens
catggactgtgtttctttttccctttgcttaggtatctgacagtggtgtgattgcacttgttagtggaccttgtgcgaagaaattagaggtaattttaaarcaattataaagatggtggtgattaaatttttatattcttagaaattatgtttaaaacctagcagataaccaatgctttatcaattacgtattttagggac

SEQ ID NO: 71048 - DNA, 201 bp, Homo sapiens
cctttaatcctttaaataactgtataataattaacatcacctccagttagacatgaggaaacattaaacattttttattgtcaattaatatattgtcattrttttcttttatagatcattcccgagaagtgttggagcaattagtaggcccaaacaaactaaagcaagtgacatggactgtttattgatgcttttttgaag

SEQ ID NO: 71049 - DNA, 201 bp, Homo sapiens
gcagactacactttgggaaccactgctttatggtaaagaaaaattatcagtcaacttcaacatttgcagcaagaatagcatatcattttctggccaggtgyggtagctcacgcctgtagtcctgcactttgggaggccaaggcaggcagatcacttgagattaggagtttgagaccagcctggccaatatggtgaaacccc

SEQ ID NO: 71050 - DNA, 201 bp, Homo sapiens
caggtctggctaatttttgtatttttagtagaaatggtgtttcaccatgttggccaggctgttgtcgaactcctgacctcaggtgatctgcccgccttggmctcccaaagttctgggattacaagcgtgagctaccacgcccagctgtttgagcgttctatagtggaaaaaatgtgaaagtcatggtattaactaaatttt

SEQ ID NO: 71051 - DNA, 201 bp, Homo sapiens
ggcaacaagagtgaaactccgtttccaaaaaaaaaaaaataataacaaatgcggttgagcattccttttttctttctttctttctttttttttttttttttgataatgagtcttgctctgtcgcccaggctggagtgcagtggtgcaatcttgactcactgcaacctccgcctcccaggttcaagtgattctcctgcctca

SEQ ID NO: 71052 - DNA, 201 bp, Homo sapiens
caaagtgctgggattatagatatgagccactacacttggcctacaattctgctacaatttgacttctaagtctatacccagttgaattgaaactgggtacycaaatacttgtacatgaatgttcatagcagcattattcacattagccaaaggtagaaaaacccagacagatgtccatcaattgatgaatcaataaacaaa

SEQ ID NO: 71053 - DNA, 201 bp, Homo sapiens
gcaaacaatcttttttgttctgtgttcctgtttaaaaagcagattaaggccgagcacaaggctcatgcctgtaatcccagcagtttgggaggccaaggtgrgaggctcacttcagcccaggagttcaagaccggcctgggcaacatatagagaccccatctctacaagaaatacagaaaattagctgattgtggtggtgca

SEQ ID NO: 71054 - DNA, 201 bp, Homo sapiens
ccaccatgctcagccttaatcagaaatgttttatgtcttgagatgtctgacacaaatatgataaaagagtaacaaaattctaggtttgaggtacatagatrtatatcaccctgttttatatttctgtatttttgaaattttttattataaaacaacaagcaaaaacttgcagaaatgaaaagaagacttgattttaaatta

SEQ ID NO: 71055 - DNA, 201 bp, Homo sapiens
cacaaatatgataaaagagtaacaaaattctaggtttgaggtacatagatgtatatcaccctgttttatatttctgtatttttgaaattttttattataaracaacaagcaaaaacttgcagaaatgaaaagaagacttgattttaaattacaaatatcataaactagaaattccacatttagtagaaaaataagaatata

SEQ ID NO: 71056 - DNA, 201 bp, Homo sapiens
tgatcttgaaaacagtgctgagtgaaaaactaaacaaatctatgacaagtcccatgtttataaattagaaatgcatgcatacaataaacatgttaaaaggmaatatacaatgaaaggatacacattaaacatgagaatggtttcctagaggggtggggaatgggagtgggaaatggagataacaaagaaatggaaagaata

SEQ ID NO: 71057 - DNA, 201 bp, Homo sapiens
tttcactatctaattgggttctgaatgacttttgcctatttcctaaaaggaattcaacctgtggacaataaagccttgccattaattgcagatactacagmctgtgtagagaattcctgaaacattccaaaagagttctgaataatgacagcatcactggaaaatcagtatttcctcacaggtggactactttgaaaaggg

SEQ ID NO: 71058 - DNA, 201 bp, Homo sapiens
ataatttttctaaattgtctgagtgttttacaataataataccttattttattttcagaaaggtaaagccatttctattttggaaaaaaaataaagaacasaaaaatacaggaaagagctcagaatgcttaggaattaatctattatttgtcaacctcaagaaaacacccaataatactggggtattttattagctcccaa

SEQ ID NO: 71059 - DNA, 201 bp, Homo sapiens
aatatgttttttttcgtttgtttttttttttgagacagagtctcactttgtcactcaggctggtatgcagtgatctcggctcactgcaacctccacctccygggttcaagcgattcttctgcctcagcttcccaagtagctgggactacaggtgcacaccaccacgcccagctaatttttgtatttttagtagagacaggg

SEQ ID NO: 71060 - DNA, 201 bp, Homo sapiens
tggtttatagcatcctctgactcaaactgaaggacaaacttaaattttgttttttgagacagggtcttgttctgtcacccagggtggagtacagtggcacratcatggcttacagcagccttgactgccctggctcaagcaatcctcccacctcagcttcctaaatagctggggctacaggtatgtgcccccactcctggc

SEQ ID NO: 71061 - DNA, 201 bp, Homo sapiens
tagtggaccttgtgcgaagaaattagaggtaattttaaaacaattataaagatggtggtgattaaatttttatattcttagaaattatgtttaaaacctascagataaccaatgctttatcaattacgtattttagggactttgttggtgggtgttctatctctttattgccagagtaaataaaaattgttaggatataaa

SEQ ID NO: 71062 - DNA, 201 bp, Homo sapiens
tttccataaaagttatgctatgagtatgcaatttcagtaagaccctaatctgccagaaatattttcttttttttaatgccttaatttaatatgttttttttcgtttgttttttttttttgagacagagtctcactttgtcactcaggctggtatgcagtgatctcggctcactgcaacctccacctcccgggttcaagcga

SEQ ID NO: 71063 - DNA, 201 bp, Homo sapiens
ttttccataaaagttatgctatgagtatgcaatttcagtaagaccctaatctgccagaaatattttcttttttttaatgccttaatttaatatgttttttttcgtttgttttttttttttgagacagagtctcactttgtcactcaggctggtatgcagtgatctcggctcactgcaacctccacctcccgggttcaagcg

SEQ ID NO: 71064 - DNA, 201 bp, Homo sapiens
gttgccaaaactcttttatttgttagatcaattcaccatatgatgatttggccaaatagtaataggttgtttcttttaagtataaaacgtagagcaactawtattggttgggatatccacccgtctccccaattgttttacagcttttaaagattataagttttagctgacttcttttcattttgtcttgagaaatgagac

SEQ ID NO: 71065 - DNA, 201 bp, Homo sapiens
acccaagagttggagtccagcctggcaacatagtgagaacttatatcttaaataaataaataaataaatacttttttattttaattttaattaattaattwatttatttattttgagacggagtcttgctctgtcgcccaggctggagtgcagtggtgtgatctcagctcactgcaacttccatgtcccaagttcaagcga

SEQ ID NO: 71066 - DNA, 201 bp, Homo sapiens
gtggaccttgtgcgaagaaattagaggtaattttaaaacaattataaagatggtggtgattaaatttttatattcttagaaattatgtttaaaacctagcrgataaccaatgctttatcaattacgtattttagggactttgttggtgggtgttctatctctttattgccagagtaaataaaaattgttaggatataaaat

SEQ ID NO: 71067 - DNA, 201 bp, Homo sapiens
ataaagatgggaaaaatacacactggggacttcaaaagggaggaaggaggaagggaagcaaggattgaaaaactacctgtcaagtactgtgttcactcttkgggtgatgggttcaattgaagcctaaacttcagcatcatgcagtatatccctgtaactaacctgcacatgtaccccctgaatctaacagttttaaaaagc

SEQ ID NO: 71068 - DNA, 201 bp, Homo sapiens
ccatgcccagccagtctaaacaattattctgtaggttaagctattatcctggaagtccctttgacaacttctcttttatttttaggaagtccctttgacarcttctcttttttatttttaggttgccagccttaaccaaggctgtaaccatagattgtatctgggtatcagtgacatctgtagtgaagattagatctttat

SEQ ID NO: 71069 - DNA, 201 bp, Homo sapiens
ggatctaacttgtaaatcagtagttatgcccagtccttccagctcatttttcttattacagtctaaataattattccaattattcttttttttttttttgrgacagaatctcgctctgtcacccgccgaggctggagtgcagtggtgcaatcttggctcactgcaacctctgccttccaggttcaagtgattctcctgcct

SEQ ID NO: 71070 - DNA, 201 bp, Homo sapiens
gaacctaattttgtacccttctgggacaaggtacagtctgagactggcagttggtcagcaagctatttctggtttgtaacaaagtaagaagcttgagccaractagtaattaagtgtgtcactaagcacattatttagtccagctgatgaggctttctccatgaaggaaacagggcttggtttatgttcttgcataaactc

SEQ ID NO: 71071 - DNA, 201 bp, Homo sapiens
tagagaatcctttggatctgggacatgaatagttttgaatagagggaccgaggaaagagaagaattagaaattactcttttagttgggggccgtggctcaygcctgtaaccccagcactttggaaggctgaggcaggtggatcacctgaggtggggagttcgagactagtctgaccaacatggagaaaccctgtctctact

SEQ ID NO: 71072 - DNA, 201 bp, Homo sapiens
tttggaaggctgaggcaggtggatcacctgaggtggggagttcgagactagtctgaccaacatggagaaaccctgtctctactaaaaatacaaaattagcyggccgtggtggtgcatgcctgtaatcccagctccttgggaggctgaggtgggagaatcgcttgaacctgggaggcagaggttgcggtgagccgagcttgc

SEQ ID NO: 71073 - DNA, 201 bp, Homo sapiens
attcagtttcctcatctgtaaaacaggcataatgagagtacctacctcatagacttagtcatgattatctgacaattctttattttattttattttatttwaattttttgggagacggagtcttgctctgtcacccaagctggagtgcaatggtgcaatctcagctcactgcaacctccacctcctgggttaaagcaattc

SEQ ID NO: 71074 - DNA, 201 bp, Homo sapiens
aggctctgcattcacttttgttttgagagactgctcacctgtggctcaaccaaataaatgaggctggtctcaaactcctggactcaagagatattcccacrttggcttccaaagtgctgggattatagatatgagccactacacttggcctacaattctgctacaatttgacttctaagtctatacccagttgaattgaaa

SEQ ID NO: 71075 - DNA, 201 bp, Homo sapiens; identical to SEQ ID NO: 41825

SEQ ID NO: 71076 - DNA, 201 bp, Homo sapiens; identical to SEQ ID NO: 39615

SEQ ID NO: 71077 - DNA, 201 bp, Homo sapiens; identical to SEQ ID NO: 39614

SEQ ID NO: 71078 - DNA, 201 bp, Homo sapiens; identical to SEQ ID NO: 41826

SEQ ID NO: 71079 - DNA, 201 bp, Homo sapiens; identical to SEQ ID NO: 39617

SEQ ID NO: 71080 - DNA, 201 bp, Homo sapiens; identical to SEQ ID NO: 39621

SEQ ID NO: 71081 - DNA, 201 bp, Homo sapiens; identical to SEQ ID NO: 39620

SEQ ID NO: 71082 - DNA, 201 bp, Homo sapiens; identical to SEQ ID NO: 39624

SEQ ID NO: 71083 - DNA, 201 bp, Homo sapiens; identical to SEQ ID NO: 39623

SEQ ID NO: 71084 - DNA, 201 bp, Homo sapiens; identical to SEQ ID NO: 39629

SEQ ID NO: 71085 - DNA, 201 bp, Homo sapiens; identical to SEQ ID NO: 39628

SEQ ID NO: 71086 - DNA, 201 bp, Homo sapiens; identical to SEQ ID NO: 39634

SEQ ID NO: 71087 - DNA, 201 bp, Homo sapiens; identical to SEQ ID NO: 39636

SEQ ID NO: 71088 - DNA, 201 bp, Homo sapiens; identical to SEQ ID NO: 38792

SEQ ID NO: 71089 - DNA, 201 bp, Homo sapiens; identical to SEQ ID NO: 39637

SEQ ID NO: 71090 - DNA, 201 bp, Homo sapiens; identical to SEQ ID NO: 38794

SEQ ID NO: 71091 - DNA, 201 bp, Homo sapiens; identical to SEQ ID NO: 41110

SEQ ID NO: 71092 - DNA, 201 bp, Homo sapiens; identical to SEQ ID NO: 38797

SEQ ID NO: 71093 - DNA, 201 bp, Homo sapiens; identical to SEQ ID NO: 41111

SEQ ID NO: 71094 - DNA, 201 bp, Homo sapiens; identical to SEQ ID NO: 39638

SEQ ID NO: 71095 - DNA, 201 bp, Homo sapiens; identical to SEQ ID NO: 39639

SEQ ID NO: 71096 - DNA, 201 bp, Homo sapiens; identical to SEQ ID NO: 37912

SEQ ID NO: 71097 - DNA, 201 bp, Homo sapiens; identical to SEQ ID NO: 38803

SEQ ID NO: 71098 - DNA, 201 bp, Homo sapiens; identical to SEQ ID NO: 38806

SEQ ID NO: 71099 - DNA, 201 bp, Homo sapiens; identical to SEQ ID NO: 41829

SEQ ID NO: 71100 - DNA, 201 bp, Homo sapiens; identical to SEQ ID NO: 38809

SEQ ID NO: 71101 - DNA, 201 bp, Homo sapiens; identical to SEQ ID NO: 41830

SEQ ID NO: 71102 - DNA, 201 bp, Homo sapiens; identical to SEQ ID NO: 38811

SEQ ID NO: 71103 - DNA, 201 bp, Homo sapiens; identical to SEQ ID NO: 38810

SEQ ID NO: 71104 - DNA, 201 bp, Homo sapiens; identical to SEQ ID NO: 38812

SEQ ID NO: 71105 - DNA, 201 bp, Homo sapiens; identical to SEQ ID NO: 42954

SEQ ID NO: 71106 - DNA, 201 bp, Homo sapiens; identical to SEQ ID NO: 41113

SEQ ID NO: 71107 - DNA, 201 bp, Homo sapiens; identical to SEQ ID NO: 42288

SEQ ID NO: 71108 - DNA, 201 bp, Homo sapiens; identical to SEQ ID NO: 42955

SEQ ID NO: 71109 - DNA, 201 bp, Homo sapiens; identical to SEQ ID NO: 41114

SEQ ID NO: 71110 - DNA, 201 bp, Homo sapiens; identical to SEQ ID NO: 42290

SEQ ID NO: 71111 - DNA, 201 bp, Homo sapiens; identical to SEQ ID NO: 42956

SEQ ID NO: 71112 - DNA, 201 bp, Homo sapiens; identical to SEQ ID NO: 42292

SEQ ID NO: 71113 - DNA, 201 bp, Homo sapiens; identical to SEQ ID NO: 42296

SEQ ID NO: 71114 - DNA, 201 bp, Homo sapiens; identical to SEQ ID NO: 42299

SEQ ID NO: 71115 - DNA, 201 bp, Homo sapiens; identical to SEQ ID NO: 42301

SEQ ID NO: 71116 - DNA, 201 bp, Homo sapiens; identical to SEQ ID NO: 42303

SEQ ID NO: 71117 - DNA, 201 bp, Homo sapiens; identical to SEQ ID NO: 42305

SEQ ID NO: 71118 - DNA, 201 bp, Homo sapiens; identical to SEQ ID NO: 41846

SEQ ID NO: 71119 - DNA, 201 bp, Homo sapiens; identical to SEQ ID NO: 39649

SEQ ID NO: 71120 - DNA, 201 bp, Homo sapiens; identical to SEQ ID NO: 41848

SEQ ID NO: 71121 - DNA, 201 bp, Homo sapiens; identical to SEQ ID NO: 39651

SEQ ID NO: 71122 - DNA, 201 bp, Homo sapiens; identical to SEQ ID NO: 41852

SEQ ID NO: 71123 - DNA, 201 bp, Homo sapiens; identical to SEQ ID NO: 42957

SEQ ID NO: 71124 - DNA, 201 bp, Homo sapiens; identical to SEQ ID NO: 39656

SEQ ID NO: 71125 - DNA, 201 bp, Homo sapiens; identical to SEQ ID NO: 39655

SEQ ID NO: 71126 - DNA, 201 bp, Homo sapiens; identical to SEQ ID NO: 39654

SEQ ID NO: 71127 - DNA, 201 bp, Homo sapiens; identical to SEQ ID NO: 39658

SEQ ID NO: 71128 - DNA, 201 bp, Homo sapiens; identical to SEQ ID NO: 39657

SEQ ID NO: 71129 - DNA, 201 bp, Homo sapiens; identical to SEQ ID NO: 39660

SEQ ID NO: 71130 - DNA, 201 bp, Homo sapiens; identical to SEQ ID NO: 39661

SEQ ID NO: 71131 - DNA, 201 bp, Homo sapiens; identical to SEQ ID NO: 39663

SEQ ID NO: 71132 - DNA, 201 bp, Homo sapiens; identical to SEQ ID NO: 39664

SEQ ID NO: 71133 - DNA, 201 bp, Homo sapiens; identical to SEQ ID NO: 39667

SEQ ID NO: 71134 - DNA, 201 bp, Homo sapiens; identical to SEQ ID NO: 39670

SEQ ID NO: 71135 - DNA, 201 bp, Homo sapiens; identical to SEQ ID NO: 40363

SEQ ID NO: 71136 - DNA, 201 bp, Homo sapiens; identical to SEQ ID NO: 39673

SEQ ID NO: 71137 - DNA, 201 bp, Homo sapiens; identical to SEQ ID NO: 39675

SEQ ID NO: 71138 - DNA, 201 bp, Homo sapiens; identical to SEQ ID NO: 41854

SEQ ID NO: 71139 - DNA, 201 bp, Homo sapiens; identical to SEQ ID NO: 42311

SEQ ID NO: 71140 - DNA, 201 bp, Homo sapiens; identical to SEQ ID NO: 41142

SEQ ID NO: 71141 - DNA, 201 bp, Homo sapiens; identical to SEQ ID NO: 39681

SEQ ID NO: 71142 - DNA, 201 bp, Homo sapiens; identical to SEQ ID NO: 38829

SEQ ID NO: 71143 - DNA, 201 bp, Homo sapiens; identical to SEQ ID NO: 41855

SEQ ID NO: 71144 - DNA, 201 bp, Homo sapiens; identical to SEQ ID NO: 38831

SEQ ID NO: 71145 - DNA, 201 bp, Homo sapiens; identical to SEQ ID NO: 38833

SEQ ID NO: 71146 - DNA, 201 bp, Homo sapiens; identical to SEQ ID NO: 38837

SEQ ID NO: 71147 - DNA, 201 bp, Homo sapiens; identical to SEQ ID NO: 38841

SEQ ID NO: 71148 - DNA, 201 bp, Homo sapiens; identical to SEQ ID NO: 41144

SEQ ID NO: 71149 - DNA, 201 bp, Homo sapiens; identical to SEQ ID NO: 37936

SEQ ID NO: 71150 - DNA, 201 bp, Homo sapiens; identical to SEQ ID NO: 41860

SEQ ID NO: 71151 - DNA, 201 bp, Homo sapiens; identical to SEQ ID NO: 39683

SEQ ID NO: 71152 - DNA, 201 bp, Homo sapiens; identical to SEQ ID NO: 37937

SEQ ID NO: 71153 - DNA, 201 bp, Homo sapiens; identical to SEQ ID NO: 37940

SEQ ID NO: 71154 - DNA, 201 bp, Homo sapiens; identical to SEQ ID NO: 42319

SEQ ID NO: 71155 - DNA, 201 bp, Homo sapiens; identical to SEQ ID NO: 38848

SEQ ID NO: 71156 - DNA, 201 bp, Homo sapiens; identical to SEQ ID NO: 42321

SEQ ID NO: 71157 - DNA, 201 bp, Homo sapiens; identical to SEQ ID NO: 38851

SEQ ID NO: 71158 - DNA, 201 bp, Homo sapiens; identical to SEQ ID NO: 42961

SEQ ID NO: 71159 - DNA, 201 bp, Homo sapiens; identical to SEQ ID NO: 42962

SEQ ID NO: 71160 - DNA, 201 bp, Homo sapiens; identical to SEQ ID NO: 42324

SEQ ID NO: 71161 - DNA, 201 bp, Homo sapiens; identical to SEQ ID NO: 42964

SEQ ID NO: 71162 - DNA, 201 bp, Homo sapiens; identical to SEQ ID NO: 42963

SEQ ID NO: 71163 - DNA, 201 bp, Homo sapiens; identical to SEQ ID NO: 42326

SEQ ID NO: 71164 - DNA, 201 bp, Homo sapiens; identical to SEQ ID NO: 42329

SEQ ID NO: 71165 - DNA, 201 bp, Homo sapiens; identical to SEQ ID NO: 42332

SEQ ID NO: 71166 - DNA, 201 bp, Homo sapiens; identical to SEQ ID NO: 40396

SEQ ID NO: 71167 - DNA, 201 bp, Homo sapiens; identical to SEQ ID NO: 40397

SEQ ID NO: 71168 - DNA, 201 bp, Homo sapiens; identical to SEQ ID NO: 42965

SEQ ID NO: 71169 - DNA, 201 bp, Homo sapiens; identical to SEQ ID NO: 40398

SEQ ID NO: 71170 - DNA, 201 bp, Homo sapiens; identical to SEQ ID NO: 39687

SEQ ID NO: 71171 - DNA, 201 bp, Homo sapiens; identical to SEQ ID NO: 40399

SEQ ID NO: 71172 - DNA, 201 bp, Homo sapiens; identical to SEQ ID NO: 39688

SEQ ID NO: 71173 - DNA, 201 bp, Homo sapiens; identical to SEQ ID NO: 40401

SEQ ID NO: 71174 - DNA, 201 bp, Homo sapiens; identical to SEQ ID NO: 39689

SEQ ID NO: 71175 - DNA, 201 bp, Homo sapiens; identical to SEQ ID NO: 40404

SEQ ID NO: 71176 - DNA, 201 bp, Homo sapiens; identical to SEQ ID NO: 39691

SEQ ID NO: 71177 - DNA, 201 bp, Homo sapiens; identical to SEQ ID NO: 39690

SEQ ID NO: 71178 - DNA, 201 bp, Homo sapiens; identical to SEQ ID NO: 40410

SEQ ID NO: 71179 - DNA, 201 bp, Homo sapiens; identical to SEQ ID NO: 39694

SEQ ID NO: 71180 - DNA, 201 bp, Homo sapiens; identical to SEQ ID NO: 40415

SEQ ID NO: 71181 - DNA, 201 bp, Homo sapiens; identical to SEQ ID NO: 39697

SEQ ID NO: 71182 - DNA, 201 bp, Homo sapiens; identical to SEQ ID NO: 40419

SEQ ID NO: 71183 - DNA, 201 bp, Homo sapiens; identical to SEQ ID NO: 39700

SEQ ID NO: 71184 - DNA, 201 bp, Homo sapiens; identical to SEQ ID NO: 40423

SEQ ID NO: 71185 - DNA, 201 bp, Homo sapiens; identical to SEQ ID NO: 39703

SEQ ID NO: 71186 - DNA, 201 bp, Homo sapiens; identical to SEQ ID NO: 39706

SEQ ID NO: 71187 - DNA, 201 bp, Homo sapiens; identical to SEQ ID NO: 39709

SEQ ID NO: 71188 - DNA, 201 bp, Homo sapiens; identical to SEQ ID NO: 40434

SEQ ID NO: 71189 - DNA, 201 bp, Homo sapiens; identical to SEQ ID NO: 40438

SEQ ID NO: 71190 - DNA, 201 bp, Homo sapiens; identical to SEQ ID NO: 41879

SEQ ID NO: 71191 - DNA, 201 bp, Homo sapiens; identical to SEQ ID NO: 38866

SEQ ID NO: 71192 - DNA, 201 bp, Homo sapiens; identical to SEQ ID NO: 39716

SEQ ID NO: 71193 - DNA, 201 bp, Homo sapiens; identical to SEQ ID NO: 41880

SEQ ID NO: 71194 - DNA, 201 bp, Homo sapiens; identical to SEQ ID NO: 41882

SEQ ID NO: 71195 - DNA, 201 bp, Homo sapiens; identical to SEQ ID NO: 41883

SEQ ID NO: 71196 - DNA, 201 bp, Homo sapiens; identical to SEQ ID NO: 41884

SEQ ID NO: 71197 - DNA, 201 bp, Homo sapiens; identical to SEQ ID NO: 38871

SEQ ID NO: 71198 - DNA, 201 bp, Homo sapiens; identical to SEQ ID NO: 38873

SEQ ID NO: 71199 - DNA, 201 bp, Homo sapiens; identical to SEQ ID NO: 39717

SEQ ID NO: 71200 - DNA, 201 bp, Homo sapiens; identical to SEQ ID NO: 37962

SEQ ID NO: 71201 - DNA, 201 bp, Homo sapiens; identical to SEQ ID NO: 38876

SEQ ID NO: 71202 - DNA, 201 bp, Homo sapiens; identical to SEQ ID NO: 38875

SEQ ID NO: 71203 - DNA, 201 bp, Homo sapiens; identical to SEQ ID NO: 39718

SEQ ID NO: 71204 - DNA, 201 bp, Homo sapiens; identical to SEQ ID NO: 41175

SEQ ID NO: 71205 - DNA, 201 bp, Homo sapiens; identical to SEQ ID NO: 37963

SEQ ID NO: 71206 - DNA, 201 bp, Homo sapiens; identical to SEQ ID NO: 38879

SEQ ID NO: 71207 - DNA, 201 bp, Homo sapiens; identical to SEQ ID NO: 38883

SEQ ID NO: 71208 - DNA, 201 bp, Homo sapiens; identical to SEQ ID NO: 38890

SEQ ID NO: 71209 - DNA, 201 bp, Homo sapiens; identical to SEQ ID NO: 42346

SEQ ID NO: 71210 - DNA, 201 bp, Homo sapiens; identical to SEQ ID NO: 42348

SEQ ID NO: 71211 - DNA, 201 bp, Homo sapiens; identical to SEQ ID NO: 42350
  misc_feature (1)...(201): n = A,T,C or G, or insertion/deletion polymorphism (see Tables 1-2)

SEQ ID NO: 71212 - DNA, 201 bp, Homo sapiens; identical to SEQ ID NO: 38895

SEQ ID NO: 71213 - DNA, 201 bp, Homo sapiens; identical to SEQ ID NO: 42967

SEQ ID NO: 71214 - DNA, 201 bp, Homo sapiens; identical to SEQ ID NO: 42968

SEQ ID NO: 71215 - DNA, 201 bp, Homo sapiens; identical to SEQ ID NO: 40467

SEQ ID NO: 71216 - DNA, 201 bp, Homo sapiens; identical to SEQ ID NO: 40469

SEQ ID NO: 71217 - DNA, 201 bp, Homo sapiens; identical to SEQ ID NO: 42352

SEQ ID NO: 71218 - DNA, 201 bp, Homo sapiens; identical to SEQ ID NO: 42353

SEQ ID NO: 71219 - DNA, 201 bp, Homo sapiens; identical to SEQ ID NO: 40471

SEQ ID NO: 71220 - DNA, 201 bp, Homo sapiens; identical to SEQ ID NO: 39721

SEQ ID NO: 71221 - DNA, 201 bp, Homo sapiens; identical to SEQ ID NO: 40473

SEQ ID NO: 71222 - DNA, 201 bp, Homo sapiens; identical to SEQ ID NO: 39722

SEQ ID NO: 71223 - DNA, 201 bp, Homo sapiens; identical to SEQ ID NO: 40476

SEQ ID NO: 71224 - DNA, 201 bp, Homo sapiens; identical to SEQ ID NO: 39723

SEQ ID NO: 71225 - DNA, 201 bp, Homo sapiens; identical to SEQ ID NO: 40479

SEQ ID NO: 71226 - DNA, 201 bp, Homo sapiens; identical to SEQ ID NO: 38904

SEQ ID NO: 71227 - DNA, 201 bp, Homo sapiens; identical to SEQ ID NO: 39724

SEQ ID NO: 71228 - DNA, 201 bp, Homo sapiens; identical to SEQ ID NO: 40482

SEQ ID NO: 71229 - DNA, 201 bp, Homo sapiens; identical to SEQ ID NO: 38905

SEQ ID NO: 71230 - DNA, 201 bp, Homo sapiens; identical to SEQ ID NO: 39725

SEQ ID NO: 71231 - DNA, 201 bp, Homo sapiens; identical to SEQ ID NO: 40487

SEQ ID NO: 71232 - DNA, 201 bp, Homo sapiens; identical to SEQ ID NO: 38906

SEQ ID NO: 71233 - DNA, 201 bp, Homo sapiens; identical to SEQ ID NO: 39726

SEQ ID NO: 71234 - DNA, 201 bp, Homo sapiens; identical to SEQ ID NO: 40492

SEQ ID NO: 71235 - DNA, 201 bp, Homo sapiens; identical to SEQ ID NO: 38907

SEQ ID NO: 71236 - DNA, 201 bp, Homo sapiens; identical to SEQ ID NO: 39728

SEQ ID NO: 71237 - DNA, 201 bp, Homo sapiens; identical to SEQ ID NO: 40497

SEQ ID NO: 71238 - DNA, 201 bp, Homo sapiens; identical to SEQ ID NO: 38908

SEQ ID NO: 71239 - DNA, 201 bp, Homo sapiens; identical to SEQ ID NO: 39729

SEQ ID NO: 71240 - DNA, 201 bp, Homo sapiens; identical to SEQ ID NO: 38909

SEQ ID NO: 71241 - DNA, 201 bp, Homo sapiens; identical to SEQ ID NO: 39731

SEQ ID NO: 71242 - DNA, 201 bp, Homo sapiens; identical to SEQ ID NO: 38910

SEQ ID NO: 71243 - DNA, 201 bp, Homo sapiens; identical to SEQ ID NO: 39733

SEQ ID NO: 71244 - DNA, 201 bp, Homo sapiens; identical to SEQ ID NO: 38911

SEQ ID NO: 71245 - DNA, 201 bp, Homo sapiens; identical to SEQ ID NO: 38912

SEQ ID NO: 71246 - DNA, 201 bp, Homo sapiens; identical to SEQ ID NO: 41902

SEQ ID NO: 71247 - DNA, 201 bp, Homo sapiens; identical to SEQ ID NO: 38914

SEQ ID NO: 71248 - DNA, 201 bp, Homo sapiens; identical to SEQ ID NO: 41903

SEQ ID NO: 71249 - DNA, 201 bp, Homo sapiens; identical to SEQ ID NO: 38917

SEQ ID NO: 71250 - DNA, 201 bp, Homo sapiens; identical to SEQ ID NO: 41906

SEQ ID NO: 71251 - DNA, 201 bp, Homo sapiens; identical to SEQ ID NO: 41207

SEQ ID NO: 71252 - DNA, 201 bp, Homo sapiens; identical to SEQ ID NO: 40520

SEQ ID NO: 71253 - DNA, 201 bp, Homo sapiens; identical to SEQ ID NO: 38918

SEQ ID NO: 71254 - DNA, 201 bp, Homo sapiens; identical to SEQ ID NO: 41209

SEQ ID NO: 71255 - DNA, 201 bp, Homo sapiens; identical to SEQ ID NO: 39742

SEQ ID NO: 71256 - DNA, 201 bp, Homo sapiens; identical to SEQ ID NO: 41912

SEQ ID NO: 71257 - DNA, 201 bp, Homo sapiens; identical to SEQ ID NO: 42368

SEQ ID NO: 71258 - DNA, 201 bp, Homo sapiens; identical to SEQ ID NO: 38920

SEQ ID NO: 71259 - DNA, 201 bp, Homo sapiens; identical to SEQ ID NO: 41917

SEQ ID NO: 71260 - DNA, 201 bp, Homo sapiens; identical to SEQ ID NO: 39746

SEQ ID NO: 71261 - DNA, 201 bp, Homo sapiens; identical to SEQ ID NO: 38922

SEQ ID NO: 71262 - DNA, 201 bp, Homo sapiens; identical to SEQ ID NO: 41217

SEQ ID NO: 71263 - DNA, 201 bp, Homo sapiens; identical to SEQ ID NO: 41218

SEQ ID NO: 71264 - DNA, 201 bp, Homo sapiens; identical to SEQ ID NO: 42371

SEQ ID NO: 71265 - DNA, 201 bp, Homo sapiens; identical to SEQ ID NO: 41220

SEQ ID NO: 71266 - DNA, 201 bp, Homo sapiens; identical to SEQ ID NO: 42372

SEQ ID NO: 71267 - DNA, 201 bp, Homo sapiens; identical to SEQ ID NO: 41222

SEQ ID NO: 71268 - DNA, 201 bp, Homo sapiens; identical to SEQ ID NO: 42373

SEQ ID NO: 71269 - DNA, 201 bp, Homo sapiens; identical to SEQ ID NO: 38930

SEQ ID NO: 71270 - DNA, 201 bp, Homo sapiens; identical to SEQ ID NO: 42374

SEQ ID NO: 71271 - DNA, 201 bp, Homo sapiens; identical to SEQ ID NO: 42375

SEQ ID NO: 71272 - DNA, 201 bp, Homo sapiens; identical to SEQ ID NO: 42376

SEQ ID NO: 71273 - DNA, 201 bp, Homo sapiens; identical to SEQ ID NO: 42377

SEQ ID NO: 71274 - DNA, 201 bp, Homo sapiens; identical to SEQ ID NO: 40541

SEQ ID NO: 71275 - DNA, 201 bp, Homo sapiens; identical to SEQ ID NO: 42378

SEQ ID NO: 71276 - DNA, 201 bp, Homo sapiens; identical to SEQ ID NO: 42380

SEQ ID NO: 71277 - DNA, 201 bp, Homo sapiens; identical to SEQ ID NO: 40543

SEQ ID NO: 71278 - DNA, 201 bp, Homo sapiens; identical to SEQ ID NO: 42379

SEQ ID NO: 71279 - DNA, 201 bp, Homo sapiens; identical to SEQ ID NO: 39754

SEQ ID NO: 71280 - DNA, 201 bp, Homo sapiens; identical to SEQ ID NO: 40548

SEQ ID NO: 71281 - DNA, 201 bp, Homo sapiens; identical to SEQ ID NO: 39755

SEQ ID NO: 71282 - DNA, 201 bp, Homo sapiens; identical to SEQ ID NO: 39757

SEQ ID NO: 71283 - DNA, 201 bp, Homo sapiens; identical to SEQ ID NO: 40554

SEQ ID NO: 71284 - DNA, 201 bp, Homo sapiens; identical to SEQ ID NO: 38939

SEQ ID NO: 71285 - DNA, 201 bp, Homo sapiens; identical to SEQ ID NO: 39759

SEQ ID NO: 71286 - DNA, 201 bp, Homo sapiens; identical to SEQ ID NO: 40559

SEQ ID NO: 71287 - DNA, 201 bp, Homo sapiens; identical to SEQ ID NO: 38940

SEQ ID NO: 71288 - DNA, 201 bp, Homo sapiens; identical to SEQ ID NO: 39761

SEQ ID NO: 71289 - DNA, 201 bp, Homo sapiens; identical to SEQ ID NO: 40562

SEQ ID NO: 71290 - DNA, 201 bp, Homo sapiens; identical to SEQ ID NO: 38941

SEQ ID NO: 71291 - DNA, 201 bp, Homo sapiens; identical to SEQ ID NO: 39762

SEQ ID NO: 71292 - DNA, 201 bp, Homo sapiens; identical to SEQ ID NO: 40564

SEQ ID NO: 71293 - DNA, 201 bp, Homo sapiens; identical to SEQ ID NO: 38942

SEQ ID NO: 71294 - DNA, 201 bp, Homo sapiens; identical to SEQ ID NO: 39763

SEQ ID NO: 71295 - DNA, 201 bp, Homo sapiens; identical to SEQ ID NO: 40567

SEQ ID NO: 71296 - DNA, 201 bp, Homo sapiens; identical to SEQ ID NO: 38943

SEQ ID NO: 71297 - DNA, 201 bp, Homo sapiens; identical to SEQ ID NO: 38944

SEQ ID NO: 71298 - DNA, 201 bp, Homo sapiens; identical to SEQ ID NO: 39765

SEQ ID NO: 71299 - DNA, 201 bp, Homo sapiens; identical to SEQ ID NO: 38945

SEQ ID NO: 71300 - DNA, 201 bp, Homo sapiens; identical to SEQ ID NO: 39767

SEQ ID NO: 71301 - DNA, 201 bp, Homo sapiens; identical to SEQ ID NO: 38946

SEQ ID NO: 71302 - DNA, 201 bp, Homo sapiens; identical to SEQ ID NO: 38947

SEQ ID NO: 71303 - DNA, 201 bp, Homo sapiens; identical to SEQ ID NO: 39769

SEQ ID NO: 71304 - DNA, 201 bp, Homo sapiens; identical to SEQ ID NO: 38949

SEQ ID NO: 71305 - DNA, 201 bp, Homo sapiens; identical to SEQ ID NO: 40574

SEQ ID NO: 71306 - DNA, 201 bp, Homo sapiens; identical to SEQ ID NO: 41934

SEQ ID NO: 71307 - DNA, 201 bp, Homo sapiens; identical to SEQ ID NO: 38951

SEQ ID NO: 71308 - DNA, 201 bp, Homo sapiens; identical to SEQ ID NO: 38953

SEQ ID NO: 71309 - DNA, 201 bp, Homo sapiens; identical to SEQ ID NO: 38954

SEQ ID NO: 71310 - DNA, 201 bp, Homo sapiens; identical to SEQ ID NO: 41938

SEQ ID NO: 71311 - DNA, 201 bp, Homo sapiens; identical to SEQ ID NO: 39771

SEQ ID NO: 71312 - DNA, 201 bp, Homo sapiens; identical to SEQ ID NO: 38956

SEQ ID NO: 71313 - DNA, 201 bp, Homo sapiens; identical to SEQ ID NO: 41250

SEQ ID NO: 71314 - DNA, 201 bp, Homo sapiens; identical to SEQ ID NO: 39774

SEQ ID NO: 71315 - DNA, 201 bp, Homo sapiens; identical to SEQ ID NO: 40589

SEQ ID NO: 71316 - DNA, 201 bp, Homo sapiens; identical to SEQ ID NO: 41264

SEQ ID NO: 71317 - DNA, 201 bp, Homo sapiens; identical to SEQ ID NO: 40591

SEQ ID NO: 71318 - DNA, 201 bp, Homo sapiens; identical to SEQ ID NO: 41266

SEQ ID NO: 71319 - DNA, 201 bp, Homo sapiens; identical to SEQ ID NO: 41268

SEQ ID NO: 71320 - DNA, 201 bp, Homo sapiens; identical to SEQ ID NO: 39784

SEQ ID NO: 71321 - DNA, 201 bp, Homo sapiens; identical to SEQ ID NO: 39785

SEQ ID NO: 71322 - DNA, 201 bp, Homo sapiens; identical to SEQ ID NO: 41272

SEQ ID NO: 71323 - DNA, 201 bp, Homo sapiens; identical to SEQ ID NO: 39786

SEQ ID NO: 71324 - DNA, 201 bp, Homo sapiens; identical to SEQ ID NO: 40594

SEQ ID NO: 71325 - DNA, 201 bp, Homo sapiens; identical to SEQ ID NO: 41274

SEQ ID NO: 71326 - DNA, 201 bp, Homo sapiens; identical to SEQ ID NO: 39788

SEQ ID NO: 71327 - DNA, 201 bp, Homo sapiens; identical to SEQ ID NO: 40595

SEQ ID NO: 71328 - DNA, 201 bp, Homo sapiens; identical to SEQ ID NO: 40596

SEQ ID NO: 71329 - DNA, 201 bp, Homo sapiens; identical to SEQ ID NO: 39790

SEQ ID NO: 71330 - DNA, 201 bp, Homo sapiens; identical to SEQ ID NO: 40598

SEQ ID NO: 71331 - DNA, 201 bp, Homo sapiens; identical to SEQ ID NO: 39792

SEQ ID NO: 71332 - DNA, 201 bp, Homo sapiens; identical to SEQ ID NO: 39791

SEQ ID NO: 71333 - DNA, 201 bp, Homo sapiens; identical to SEQ ID NO: 40599

SEQ ID NO: 71334 - DNA, 201 bp, Homo sapiens; identical to SEQ ID NO: 41281

SEQ ID NO: 71335 - DNA, 201 bp, Homo sapiens; identical to SEQ ID NO: 39794

SEQ ID NO: 71336 - DNA, 201 bp, Homo sapiens; identical to SEQ ID NO: 39793

SEQ ID NO: 71337 - DNA, 201 bp, Homo sapiens; identical to SEQ ID NO: 40600

SEQ ID NO: 71338 - DNA, 201 bp, Homo sapiens; identical to SEQ ID NO: 41284

SEQ ID NO: 71339 - DNA, 201 bp, Homo sapiens; identical to SEQ ID NO: 39796

SEQ ID NO: 71340 - DNA, 201 bp, Homo sapiens; identical to SEQ ID NO: 40601

SEQ ID NO: 71341 - DNA, 201 bp, Homo sapiens; identical to SEQ ID NO: 38964

SEQ ID NO: 71342 - DNA, 201 bp, Homo sapiens; identical to SEQ ID NO: 39799

SEQ ID NO: 71343 - DNA, 201 bp, Homo sapiens; identical to SEQ ID NO: 39798

SEQ ID NO: 71344 - DNA, 201 bp, Homo sapiens; identical to SEQ ID NO: 40603

SEQ ID NO: 71345 - DNA, 201 bp, Homo sapiens; identical to SEQ ID NO: 38965

SEQ ID NO: 71346 - DNA, 201 bp, Homo sapiens; identical to SEQ ID NO: 39802

SEQ ID NO: 71347 - DNA, 201 bp, Homo sapiens; identical to SEQ ID NO: 38966

SEQ ID NO: 71348 - DNA, 201 bp, Homo sapiens; identical to SEQ ID NO: 39805

SEQ ID NO: 71349 - DNA, 201 bp, Homo sapiens; identical to SEQ ID NO: 40607

SEQ ID NO: 71350 - DNA, 201 bp, Homo sapiens; identical to SEQ ID NO: 38967

SEQ ID NO: 71351 - DNA, 201 bp, Homo sapiens; identical to SEQ ID NO: 39809

SEQ ID NO: 71352 - DNA, 201 bp, Homo sapiens; identical to SEQ ID NO: 40609

SEQ ID NO: 71353 - DNA, 201 bp, Homo sapiens; identical to SEQ ID NO: 38968

SEQ ID NO: 71354 - DNA, 201 bp, Homo sapiens; identical to SEQ ID NO: 39813

SEQ ID NO: 71355 - DNA, 201 bp, Homo sapiens; identical to SEQ ID NO: 41297

SEQ ID NO: 71356 - DNA, 201 bp, Homo sapiens; identical to SEQ ID NO: 38969

SEQ ID NO: 71357 - DNA, 201 bp, Homo sapiens; identical to SEQ ID NO: 39816

SEQ ID NO: 71358 - DNA, 201 bp, Homo sapiens; identical to SEQ ID NO: 38970

SEQ ID NO: 71359 - DNA, 201 bp, Homo sapiens; identical to SEQ ID NO: 39817

SEQ ID NO: 71360 - DNA, 201 bp, Homo sapiens; identical to SEQ ID NO: 38971

SEQ ID NO: 71361 - DNA, 201 bp, Homo sapiens; identical to SEQ ID NO: 38972

SEQ ID NO: 71362 - DNA, 201 bp, Homo sapiens; identical to SEQ ID NO: 38973

SEQ ID NO: 71363 - DNA, 201 bp, Homo sapiens; identical to SEQ ID NO: 41975

SEQ ID NO: 71364 - DNA, 201 bp, Homo sapiens; identical to SEQ ID NO: 41313

SEQ ID NO: 71365 - DNA, 201 bp, Homo sapiens; identical to SEQ ID NO: 39823

SEQ ID NO: 71366 - DNA, 201 bp, Homo sapiens; identical to SEQ ID NO: 39824

SEQ ID NO: 71367 - DNA, 201 bp, Homo sapiens; identical to SEQ ID NO: 40639

SEQ ID NO: 71368 - DNA, 201 bp, Homo sapiens; identical to SEQ ID NO: 39826

SEQ ID NO: 71369 - DNA, 201 bp, Homo sapiens; identical to SEQ ID NO: 40640

SEQ ID NO: 71370 - DNA, 201 bp, Homo sapiens; identical to SEQ ID NO: 39828

SEQ ID NO: 71371 - DNA, 201 bp, Homo sapiens; identical to SEQ ID NO: 40642

SEQ ID NO: 71372 - DNA, 201 bp, Homo sapiens; identical to SEQ ID NO: 39831

SEQ ID NO: 71373 - DNA, 201 bp, Homo sapiens; identical to SEQ ID NO: 39830

SEQ ID NO: 71374 - DNA, 201 bp, Homo sapiens; identical to SEQ ID NO: 40643

SEQ ID NO: 71375 - DNA, 201 bp, Homo sapiens; identical to SEQ ID NO: 42414

SEQ ID NO: 71376 - DNA, 201 bp, Homo sapiens; identical to SEQ ID NO: 39833

SEQ ID NO: 71377 - DNA, 201 bp, Homo sapiens; identical to SEQ ID NO: 39832

SEQ ID NO: 71378 - DNA, 201 bp, Homo sapiens; identical to SEQ ID NO: 40644

SEQ ID NO: 71379 - DNA, 201 bp, Homo sapiens; identical to SEQ ID NO: 39835

SEQ ID NO: 71380 - DNA, 201 bp, Homo sapiens; identical to SEQ ID NO: 39834

SEQ ID NO: 71381 - DNA, 201 bp, Homo sapiens; identical to SEQ ID NO: 40647

SEQ ID NO: 71382 - DNA, 201 bp, Homo sapiens; identical to SEQ ID NO: 39837

SEQ ID NO: 71383 - DNA, 201 bp, Homo sapiens; identical to SEQ ID NO: 39836

SEQ ID NO: 71384 - DNA, 201 bp, Homo sapiens; identical to SEQ ID NO: 40651

SEQ ID NO: 71385 - DNA, 201 bp, Homo sapiens; identical to SEQ ID NO: 39838

SEQ ID NO: 71386 - DNA, 201 bp, Homo sapiens; identical to SEQ ID NO: 39839

SEQ ID NO: 71387 - DNA, 201 bp, Homo sapiens; identical to SEQ ID NO: 40657

SEQ ID NO: 71388 - DNA, 201 bp, Homo sapiens; identical to SEQ ID NO: 39841

SEQ ID NO: 71389 - DNA, 201 bp, Homo sapiens; identical to SEQ ID NO: 40661

SEQ ID NO: 71390 - DNA, 201 bp, Homo sapiens; identical to SEQ ID NO: 39842

SEQ ID NO: 71391 - DNA, 201 bp, Homo sapiens; identical to SEQ ID NO: 40665

SEQ ID NO: 71392 - DNA, 201 bp, Homo sapiens; identical to SEQ ID NO: 41341

SEQ ID NO: 71393 - DNA, 201 bp, Homo sapiens; identical to SEQ ID NO: 39844

SEQ ID NO: 71394 - DNA, 201 bp, Homo sapiens; identical to SEQ ID NO: 40668

SEQ ID NO: 71395 - DNA, 201 bp, Homo sapiens; identical to SEQ ID NO: 41343

SEQ ID NO: 71396 - DNA, 201 bp, Homo sapiens; identical to SEQ ID NO: 39846

SEQ ID NO: 71397 - DNA, 201 bp, Homo sapiens; identical to SEQ ID NO: 41348

SEQ ID NO: 71398 - DNA, 201 bp, Homo sapiens; identical to SEQ ID NO: 42422

SEQ ID NO: 71399 - DNA, 201 bp, Homo sapiens; identical to SEQ ID NO: 41999

SEQ ID NO: 71400 - DNA, 201 bp, Homo sapiens; identical to SEQ ID NO: 41350

SEQ ID NO: 71401 - DNA, 201 bp, Homo sapiens; identical to SEQ ID NO: 42423

SEQ ID NO: 71402 - DNA, 201 bp, Homo sapiens; identical to SEQ ID NO: 42000

SEQ ID NO: 71403 - DNA, 201 bp, Homo sapiens; identical to SEQ ID NO: 39849

SEQ ID NO: 71404 - DNA, 201 bp, Homo sapiens; identical to SEQ ID NO: 42002

SEQ ID NO: 71405 - DNA, 201 bp, Homo sapiens; identical to SEQ ID NO: 42431

SEQ ID NO: 71406 - DNA, 201 bp, Homo sapiens; identical to SEQ ID NO: 42005

SEQ ID NO: 71407 - DNA, 201 bp, Homo sapiens; identical to SEQ ID NO: 42434

SEQ ID NO: 71408 - DNA, 201 bp, Homo sapiens; identical to SEQ ID NO: 42435

SEQ ID NO: 71409 - DNA, 201 bp, Homo sapiens; identical to SEQ ID NO: 39856

SEQ ID NO: 71410 - DNA, 201 bp, Homo sapiens; identical to SEQ ID NO: 39857

SEQ ID NO: 71411 - DNA, 201 bp, Homo sapiens; identical to SEQ ID NO: 39858

SEQ ID NO: 71412 - DNA, 201 bp, Homo sapiens; identical to SEQ ID NO: 40691

SEQ ID NO: 71413 - DNA, 201 bp, Homo sapiens; identical to SEQ ID NO: 40692

SEQ ID NO: 71414 - DNA, 201 bp, Homo sapiens; identical to SEQ ID NO: 39860

SEQ ID NO: 71415 - DNA, 201 bp, Homo sapiens; identical to SEQ ID NO: 40693

SEQ ID NO: 71416 - DNA, 201 bp, Homo sapiens; identical to SEQ ID NO: 39862

SEQ ID NO: 71417 - DNA, 201 bp, Homo sapiens; identical to SEQ ID NO: 39861

SEQ ID NO: 71418 - DNA, 201 bp, Homo sapiens; identical to SEQ ID NO: 40694

SEQ ID NO: 71419 - DNA, 201 bp, Homo sapiens; identical to SEQ ID NO: 39864

SEQ ID NO: 71420 - DNA, 201 bp, Homo sapiens; identical to SEQ ID NO: 39863

SEQ ID NO: 71421 - DNA, 201 bp, Homo sapiens; identical to SEQ ID NO: 39867

SEQ ID NO: 71422 - DNA, 201 bp, Homo sapiens; identical to SEQ ID NO: 40696

SEQ ID NO: 71423 - DNA, 201 bp, Homo sapiens; identical to SEQ ID NO: 39866

SEQ ID NO: 71424 - DNA, 201 bp, Homo sapiens; identical to SEQ ID NO: 39869

SEQ ID NO: 71425 - DNA, 201 bp, Homo sapiens; identical to SEQ ID NO: 40697

SEQ ID NO: 71426 - DNA, 201 bp, Homo sapiens; identical to SEQ ID NO: 39868

SEQ ID NO: 71427 - DNA, 201 bp, Homo sapiens; identical to SEQ ID NO: 39872

SEQ ID NO: 71428 - DNA, 201 bp, Homo sapiens; identical to SEQ ID NO: 40698

SEQ ID NO: 71429 - DNA, 201 bp, Homo sapiens; identical to SEQ ID NO: 39874

SEQ ID NO: 71430 - DNA, 201 bp, Homo sapiens; identical to SEQ ID NO: 40699

SEQ ID NO: 71431 - DNA, 201 bp, Homo sapiens; identical to SEQ ID NO: 38058

SEQ ID NO: 71432 - DNA, 201 bp, Homo sapiens; identical to SEQ ID NO: 39876

SEQ ID NO: 71433 - DNA, 201 bp, Homo sapiens; identical to SEQ ID NO: 40701

SEQ ID NO: 71434 - DNA, 201 bp, Homo sapiens; identical to SEQ ID NO: 39877

SEQ ID NO: 71435 - DNA, 201 bp, Homo sapiens; identical to SEQ ID NO: 40703

SEQ ID NO: 71436 - DNA, 201 bp, Homo sapiens; identical to SEQ ID NO: 39878

SEQ ID NO: 71437 - DNA, 201 bp, Homo sapiens; identical to SEQ ID NO: 40705

SEQ ID NO: 71438 - DNA, 201 bp, Homo sapiens; identical to SEQ ID NO: 40706

SEQ ID NO: 71439 - DNA, 201 bp, Homo sapiens; identical to SEQ ID NO: 39880

SEQ ID NO: 71440 - DNA, 201 bp, Homo sapiens; identical to SEQ ID NO: 40709

SEQ ID NO: 71441 - DNA, 201 bp, Homo sapiens; identical to SEQ ID NO: 40710

SEQ ID NO: 71442 - DNA, 201 bp, Homo sapiens; identical to SEQ ID NO: 42015

SEQ ID NO: 71443 - DNA, 201 bp, Homo sapiens; identical to SEQ ID NO: 43033

SEQ ID NO: 71444 - DNA, 201 bp, Homo sapiens; identical to SEQ ID NO: 43032

SEQ ID NO: 71445 - DNA, 201 bp, Homo sapiens; identical to SEQ ID NO: 39885

SEQ ID NO: 71446 - DNA, 201 bp, Homo sapiens; identical to SEQ ID NO: 39886

SEQ ID NO: 71447 - DNA, 201 bp, Homo sapiens; identical to SEQ ID NO: 39887

SEQ ID NO: 71448 - DNA, 201 bp, Homo sapiens; identical to SEQ ID NO: 42456

SEQ ID NO: 71449 - DNA, 201 bp, Homo sapiens; identical to SEQ ID NO: 40724

SEQ ID NO: 71450 - DNA, 201 bp, Homo sapiens; identical to SEQ ID NO: 39888

SEQ ID NO: 71451 - DNA, 201 bp, Homo sapiens; identical to SEQ ID NO: 40728

SEQ ID NO: 71452 - DNA, 201 bp, Homo sapiens; identical to SEQ ID NO: 39889

SEQ ID NO: 71453 - DNA, 201 bp, Homo sapiens; identical to SEQ ID NO: 38997

SEQ ID NO: 71454 - DNA, 201 bp, Homo sapiens; identical to SEQ ID NO: 39891

SEQ ID NO: 71455 - DNA, 201 bp, Homo sapiens; identical to SEQ ID NO: 40729

SEQ ID NO: 71456 - DNA, 201 bp, Homo sapiens; identical to SEQ ID NO: 39890

SEQ ID NO: 71457 - DNA, 201 bp, Homo sapiens; identical to SEQ ID NO: 38999

SEQ ID NO: 71458 - DNA, 201 bp, Homo sapiens; identical to SEQ ID NO: 39892

SEQ ID NO: 71459 - DNA, 201 bp, Homo sapiens; identical to SEQ ID NO: 40731

SEQ ID NO: 71460 - DNA, 201 bp, Homo sapiens; identical to SEQ ID NO: 39001

SEQ ID NO: 71461 - DNA, 201 bp, Homo sapiens; identical to SEQ ID NO: 39893

SEQ ID NO: 71462 - DNA, 201 bp, Homo sapiens; identical to SEQ ID NO: 40732

SEQ ID NO: 71463 - DNA, 201 bp, Homo sapiens; identical to SEQ ID NO: 39003

SEQ ID NO: 71464 - DNA, 201 bp, Homo sapiens; identical to SEQ ID NO: 39895

SEQ ID NO: 71465 - DNA, 201 bp, Homo sapiens; identical to SEQ ID NO: 40733

SEQ ID NO: 71466 - DNA, 201 bp, Homo sapiens; identical to SEQ ID NO: 39894

SEQ ID NO: 71467 - DNA, 201 bp, Homo sapiens; identical to SEQ ID NO: 39005

SEQ ID NO: 71468 - DNA, 201 bp, Homo sapiens; identical to SEQ ID NO: 39896

SEQ ID NO: 71469 - DNA, 201 bp, Homo sapiens; identical to SEQ ID NO: 39897

SEQ ID NO: 71470 - DNA, 201 bp, Homo sapiens; identical to SEQ ID NO: 40736

SEQ ID NO: 71471 - DNA, 201 bp, Homo sapiens; identical to SEQ ID NO: 39898

SEQ ID NO: 71472 - DNA, 201 bp, Homo sapiens; identical to SEQ ID NO: 40738

SEQ ID NO: 71473 - DNA, 201 bp, Homo sapiens; identical to SEQ ID NO: 39899

SEQ ID NO: 71474 - DNA, 201 bp, Homo sapiens; identical to SEQ ID NO: 39900

SEQ ID NO: 71475 - DNA, 201 bp, Homo sapiens; identical to SEQ ID NO: 39901

SEQ ID NO: 71476 - DNA, 201 bp, Homo sapiens; identical to SEQ ID NO: 40739

SEQ ID NO: 71477 - DNA, 201 bp, Homo sapiens; identical to SEQ ID NO: 40740

SEQ ID NO: 71478 - DNA, 201 bp, Homo sapiens; identical to SEQ ID NO: 39903

SEQ ID NO: 71479 - DNA, 201 bp, Homo sapiens; identical to SEQ ID NO: 39904

SEQ ID NO: 71480 - DNA, 201 bp, Homo sapiens; identical to SEQ ID NO: 43035

SEQ ID NO: 71481 - DNA, 201 bp, Homo sapiens; identical to SEQ ID NO: 43036

SEQ ID NO: 71482 - DNA, 201 bp, Homo sapiens; identical to SEQ ID NO: 42471

SEQ ID NO: 71483 - DNA, 201 bp, Homo sapiens; identical to SEQ ID NO: 42473

SEQ ID NO: 71484 - DNA, 201 bp, Homo sapiens; identical to SEQ ID NO: 43038

SEQ ID NO: 71485 - DNA, 201 bp, Homo sapiens; identical to SEQ ID NO: 43037

SEQ ID NO: 71486 - DNA, 201 bp, Homo sapiens; identical to SEQ ID NO: 42474

SEQ ID NO: 71487 - DNA, 201 bp, Homo sapiens; identical to SEQ ID NO: 42475

SEQ ID NO: 71488 - DNA, 201 bp, Homo sapiens; identical to SEQ ID NO: 42476

SEQ ID NO: 71489 - DNA, 201 bp, Homo sapiens; identical to SEQ ID NO: 42477

SEQ ID NO: 71490 - DNA, 201 bp, Homo sapiens; identical to SEQ ID NO: 42478

SEQ ID NO: 71491 - DNA, 201 bp, Homo sapiens; identical to SEQ ID NO: 42479

SEQ ID NO: 71492 - DNA, 201 bp, Homo sapiens; identical to SEQ ID NO: 39906

SEQ ID NO: 71493 - DNA, 201 bp, Homo sapiens; identical to SEQ ID NO: 40749

SEQ ID NO: 71494 - DNA, 201 bp, Homo sapiens; identical to SEQ ID NO: 40751

SEQ ID NO: 71495 - DNA, 201 bp, Homo sapiens; identical to SEQ ID NO: 40752

SEQ ID NO: 71496 - DNA, 201 bp, Homo sapiens; identical to SEQ ID NO: 39025

SEQ ID NO: 71497 - DNA, 201 bp, Homo sapiens; identical to SEQ ID NO: 40753

SEQ ID NO: 71498 - DNA, 201 bp, Homo sapiens; identical to SEQ ID NO: 40754

SEQ ID NO: 71499 - DNA, 201 bp, Homo sapiens; identical to SEQ ID NO: 39028

SEQ ID NO: 71500 - DNA, 201 bp, Homo sapiens; identical to SEQ ID NO: 40755

SEQ ID NO: 71501 - DNA, 201 bp, Homo sapiens; identical to SEQ ID NO: 39030

SEQ ID NO: 71502 - DNA, 201 bp, Homo sapiens; identical to SEQ ID NO: 40757

SEQ ID NO: 71503 - DNA, 201 bp, Homo sapiens; identical to SEQ ID NO: 39032

SEQ ID NO: 71504 - DNA, 201 bp, Homo sapiens; identical to SEQ ID NO: 40760

SEQ ID NO: 71505 - DNA, 201 bp, Homo sapiens; identical to SEQ ID NO: 39033

SEQ ID NO: 71506 - DNA, 201 bp, Homo sapiens; identical to SEQ ID NO: 40762

SEQ ID NO: 71507 - DNA, 201 bp, Homo sapiens; identical to SEQ ID NO: 39034

SEQ ID NO: 71508 - DNA, 201 bp, Homo sapiens; identical to SEQ ID NO: 40763

SEQ ID NO: 71509 - DNA, 201 bp, Homo sapiens; identical to SEQ ID NO: 40764

SEQ ID NO: 71510 - DNA, 201 bp, Homo sapiens; identical to SEQ ID NO: 43047

SEQ ID NO: 71511 - DNA, 201 bp, Homo sapiens; identical to SEQ ID NO: 40765

SEQ ID NO: 71512 - DNA, 201 bp, Homo sapiens; identical to SEQ ID NO: 40766

SEQ ID NO: 71513 - DNA, 201 bp, Homo sapiens; identical to SEQ ID NO: 43048

SEQ ID NO: 71514 - DNA, 201 bp, Homo sapiens; identical to SEQ ID NO: 43051

SEQ ID NO: 71515 - DNA, 201 bp, Homo sapiens; identical to SEQ ID NO: 39910

SEQ ID NO: 71516 - DNA, 201 bp, Homo sapiens; identical to SEQ ID NO: 39911

SEQ ID NO: 71517 - DNA, 201 bp, Homo sapiens; identical to SEQ ID NO: 42496

SEQ ID NO: 71518 - DNA, 201 bp, Homo sapiens; identical to SEQ ID NO: 42497

SEQ ID NO: 71519 - DNA, 201 bp, Homo sapiens; identical to SEQ ID NO: 42498

SEQ ID NO: 71520 - DNA, 201 bp, Homo sapiens; identical to SEQ ID NO: 39914

SEQ ID NO: 71521 - DNA, 201 bp, Homo sapiens; identical to SEQ ID NO: 39915

SEQ ID NO: 71522 - DNA, 201 bp, Homo sapiens; identical to SEQ ID NO: 39916

SEQ ID NO: 71523 - DNA, 201 bp, Homo sapiens; identical to SEQ ID NO: 39917

SEQ ID NO: 71524 - DNA, 201 bp, Homo sapiens; identical to SEQ ID NO: 40776

SEQ ID NO: 71525 - DNA, 201 bp, Homo sapiens; identical to SEQ ID NO: 40779

SEQ ID NO: 71526 - DNA, 201 bp, Homo sapiens; identical to SEQ ID NO: 40781

SEQ ID NO: 71527 - DNA, 201 bp, Homo sapiens; identical to SEQ ID NO: 39052

SEQ ID NO: 71528 - DNA, 201 bp, Homo sapiens; identical to SEQ ID NO: 42035

SEQ ID NO: 71529 - DNA, 201 bp, Homo sapiens; identical to SEQ ID NO: 40783

SEQ ID NO: 71530 - DNA, 201 bp, Homo sapiens; identical to SEQ ID NO: 39055

SEQ ID NO: 71531 - DNA, 201 bp, Homo sapiens; identical to SEQ ID NO: 40785

SEQ ID NO: 71532 - DNA, 201 bp, Homo sapiens; identical to SEQ ID NO: 39057

SEQ ID NO: 71533 - DNA, 201 bp, Homo sapiens; identical to SEQ ID NO: 40786

SEQ ID NO: 71534 - DNA, 201 bp, Homo sapiens; identical to SEQ ID NO: 39059

SEQ ID NO: 71535 - DNA, 201 bp, Homo sapiens; identical to SEQ ID NO: 39919

SEQ ID NO: 71536 - DNA, 201 bp, Homo sapiens; identical to SEQ ID NO: 39061

SEQ ID NO: 71537 - DNA, 201 bp, Homo sapiens; identical to SEQ ID NO: 40788

SEQ ID NO: 71538 - DNA, 201 bp, Homo sapiens; identical to SEQ ID NO: 39062

SEQ ID NO: 71539 - DNA, 201 bp, Homo sapiens; identical to SEQ ID NO: 40789

SEQ ID NO: 71540 - DNA, 201 bp, Homo sapiens; identical to SEQ ID NO: 39063

SEQ ID NO: 71541 - DNA, 201 bp, Homo sapiens; identical to SEQ ID NO: 40790

SEQ ID NO: 71542 - DNA, 201 bp, Homo sapiens; identical to SEQ ID NO: 43053

SEQ ID NO: 71543 - DNA, 201 bp, Homo sapiens; identical to SEQ ID NO: 43054

SEQ ID NO: 71544 - DNA, 201 bp, Homo sapiens; identical to SEQ ID NO: 43055

SEQ ID NO: 71545 - DNA, 201 bp, Homo sapiens; identical to SEQ ID NO: 43057

SEQ ID NO: 71546 - DNA, 201 bp, Homo sapiens; identical to SEQ ID NO: 39933

SEQ ID NO: 71547 - DNA, 201 bp, Homo sapiens; identical to SEQ ID NO: 39088

SEQ ID NO: 71548 - DNA, 201 bp, Homo sapiens; identical to SEQ ID NO: 42047

SEQ ID NO: 71549 - DNA, 201 bp, Homo sapiens; identical to SEQ ID NO: 40808

SEQ ID NO: 71550 - DNA, 201 bp, Homo sapiens; identical to SEQ ID NO: 39092

SEQ ID NO: 71551 - DNA, 201 bp, Homo sapiens; identical to SEQ ID NO: 40810

SEQ ID NO: 71552 - DNA, 201 bp, Homo sapiens; identical to SEQ ID NO: 41500

SEQ ID NO: 71553 - DNA, 201 bp, Homo sapiens; identical to SEQ ID NO: 39094

SEQ ID NO: 71554 - DNA, 201 bp, Homo sapiens; identical to SEQ ID NO: 41501

SEQ ID NO: 71555 - DNA, 201 bp, Homo sapiens; identical to SEQ ID NO: 40814

SEQ ID NO: 71556 - DNA, 201 bp, Homo sapiens; identical to SEQ ID NO: 41502

SEQ ID NO: 71557 - DNA, 201 bp, Homo sapiens; identical to SEQ ID NO: 40815

SEQ ID NO: 71558 - DNA, 201 bp, Homo sapiens; identical to SEQ ID NO: 41503

SEQ ID NO: 71559 - DNA, 201 bp, Homo sapiens; identical to SEQ ID NO: 40816

SEQ ID NO: 71560 - DNA, 201 bp, Homo sapiens; identical to SEQ ID NO: 41504

SEQ ID NO: 71561 - DNA, 201 bp, Homo sapiens; identical to SEQ ID NO: 39102

SEQ ID NO: 71562 - DNA, 201 bp, Homo sapiens; identical to SEQ ID NO: 40817

SEQ ID NO: 71563 - DNA, 201 bp, Homo sapiens; identical to SEQ ID NO: 39103

SEQ ID NO: 71564 - DNA, 201 bp, Homo sapiens; identical to SEQ ID NO: 40818

SEQ ID NO: 71565 - DNA, 201 bp, Homo sapiens; identical to SEQ ID NO: 40819

SEQ ID NO: 71566 - DNA, 201 bp, Homo sapiens; identical to SEQ ID NO: 39104

SEQ ID NO: 71567 - DNA, 201 bp, Homo sapiens; identical to SEQ ID NO: 41512

SEQ ID NO: 71568 - DNA, 201 bp, Homo sapiens; identical to SEQ ID NO: 41513

SEQ ID NO: 71569 - DNA, 201 bp, Homo sapiens; identical to SEQ ID NO: 39943

SEQ ID NO: 71570 - DNA, 201 bp, Homo sapiens; identical to SEQ ID NO: 43066

SEQ ID NO: 71571 - DNA, 201 bp, Homo sapiens; identical to SEQ ID NO: 43067

SEQ ID NO: 71572 - DNA, 201 bp, Homo sapiens; identical to SEQ ID NO: 43068

SEQ ID NO: 71573 - DNA, 201 bp, Homo sapiens; identical to SEQ ID NO: 42068

SEQ ID NO: 71574 - DNA, 201 bp, Homo sapiens; identical to SEQ ID NO: 38190

SEQ ID NO: 71575 - DNA, 201 bp, Homo sapiens; identical to SEQ ID NO: 41518

SEQ ID NO: 71576 - DNA, 201 bp, Homo sapiens; identical to SEQ ID NO: 41519

SEQ ID NO: 71577 - DNA, 201 bp, Homo sapiens; identical to SEQ ID NO: 38195

SEQ ID NO: 71578 - DNA, 201 bp, Homo sapiens; identical to SEQ ID NO: 41522

SEQ ID NO: 71579 - DNA, 201 bp, Homo sapiens; identical to SEQ ID NO: 38201

SEQ ID NO: 71580 - DNA, 201 bp, Homo sapiens; identical to SEQ ID NO: 38206

SEQ ID NO: 71581 - DNA, 201 bp, Homo sapiens; identical to SEQ ID NO: 41536

SEQ ID NO: 71582 - DNA, 201 bp, Homo sapiens; identical to SEQ ID NO: 41537

SEQ ID NO: 71583 - DNA, 201 bp, Homo sapiens; identical to SEQ ID NO: 41539

SEQ ID NO: 71584 - DNA, 201 bp, Homo sapiens; identical to SEQ ID NO: 42544

SEQ ID NO: 71585 - DNA, 201 bp, Homo sapiens; identical to SEQ ID NO: 42546

SEQ ID NO: 71586 - DNA, 201 bp, Homo sapiens; identical to SEQ ID NO: 42547

SEQ ID NO: 71587 - DNA, 201 bp, Homo sapiens; identical to SEQ ID NO: 42084

SEQ ID NO: 71588 - DNA, 201 bp, Homo sapiens; identical to SEQ ID NO: 42086

SEQ ID NO: 71589 - DNA, 201 bp, Homo sapiens; identical to SEQ ID NO: 41562

SEQ ID NO: 71590 - DNA, 201 bp, Homo sapiens; identical to SEQ ID NO: 38259

SEQ ID NO: 71591 - DNA, 201 bp, Homo sapiens; identical to SEQ ID NO: 41564

SEQ ID NO: 71592 - DNA, 201 bp, Homo sapiens; identical to SEQ ID NO: 38260

SEQ ID NO: 71593 - DNA, 201 bp, Homo sapiens; identical to SEQ ID NO: 41565

SEQ ID NO: 71594 - DNA, 201 bp, Homo sapiens; identical to SEQ ID NO: 40857

SEQ ID NO: 71595 - DNA, 201 bp, Homo sapiens; identical to SEQ ID NO: 41567

SEQ ID NO: 71596 - DNA, 201 bp, Homo sapiens; identical to SEQ ID NO: 41569

SEQ ID NO: 71597 - DNA, 201 bp, Homo sapiens; identical to SEQ ID NO: 41570

SEQ ID NO: 71598 - DNA, 201 bp, Homo sapiens; identical to SEQ ID NO: 41571

SEQ ID NO: 71599 - DNA, 201 bp, Homo sapiens; identical to SEQ ID NO: 42562

SEQ ID NO: 71600 - DNA, 201 bp, Homo sapiens; identical to SEQ ID NO: 42563

SEQ ID NO: 71601 - DNA, 201 bp, Homo sapiens; identical to SEQ ID NO: 42567

SEQ ID NO: 71602 - DNA, 201 bp, Homo sapiens; identical to SEQ ID NO: 40871

SEQ ID NO: 71603 - DNA, 201 bp, Homo sapiens; identical to SEQ ID NO: 40873

SEQ ID NO: 71604 - DNA, 201 bp, Homo sapiens; identical to SEQ ID NO: 38291

SEQ ID NO: 71605 - DNA, 201 bp, Homo sapiens; identical to SEQ ID NO: 41597

SEQ ID NO: 71606 - DNA, 201 bp, Homo sapiens; identical to SEQ ID NO: 38292

SEQ ID NO: 71607 - DNA, 201 bp, Homo sapiens; identical to SEQ ID NO: 41598

SEQ ID NO: 71608 - DNA, 201 bp, Homo sapiens; identical to SEQ ID NO: 41600

SEQ ID NO: 71609 - DNA, 201 bp, Homo sapiens; identical to SEQ ID NO: 40003

SEQ ID NO: 71610 - DNA, 201 bp, Homo sapiens; identical to SEQ ID NO: 42593

SEQ ID NO: 71611 - DNA, 201 bp, Homo sapiens; identical to SEQ ID NO: 40887

SEQ ID NO: 71612 - DNA, 201 bp, Homo sapiens; identical to SEQ ID NO: 40888

SEQ ID NO: 71613 - DNA, 201 bp, Homo sapiens; identical to SEQ ID NO: 40889

SEQ ID NO: 71614 - DNA, 201 bp, Homo sapiens; identical to SEQ ID NO: 38314

SEQ ID NO: 71615 - DNA, 201 bp, Homo sapiens; identical to SEQ ID NO: 41608

SEQ ID NO: 71616 - DNA, 201 bp, Homo sapiens; identical to SEQ ID NO: 38315

SEQ ID NO: 71617 - DNA, 201 bp, Homo sapiens; identical to SEQ ID NO: 41609

SEQ ID NO: 71618 - DNA, 201 bp, Homo sapiens; identical to SEQ ID NO: 41612

SEQ ID NO: 71619 - DNA, 201 bp, Homo sapiens; identical to SEQ ID NO: 38316

SEQ ID NO: 71620 - DNA, 201 bp, Homo sapiens; identical to SEQ ID NO: 38318

SEQ ID NO: 71621 - DNA, 201 bp, Homo sapiens; identical to SEQ ID NO: 41613

SEQ ID NO: 71622 - DNA, 201 bp, Homo sapiens; identical to SEQ ID NO: 38320

SEQ ID NO: 71623 - DNA, 201 bp, Homo sapiens; identical to SEQ ID NO: 40010

SEQ ID NO: 71624 - DNA, 201 bp, Homo sapiens; identical to SEQ ID NO: 42623

SEQ ID NO: 71625 - DNA, 201 bp, Homo sapiens; identical to SEQ ID NO: 40011

SEQ ID NO: 71626 - DNA, 201 bp, Homo sapiens; identical to SEQ ID NO: 39219

SEQ ID NO: 71627 - DNA, 201 bp, Homo sapiens; identical to SEQ ID NO: 41622

SEQ ID NO: 71628 - DNA, 201 bp, Homo sapiens; identical to SEQ ID NO: 39222

SEQ ID NO: 71629 - DNA, 201 bp, Homo sapiens; identical to SEQ ID NO: 40922

SEQ ID NO: 71630 - DNA, 201 bp, Homo sapiens; identical to SEQ ID NO: 39224

SEQ ID NO: 71631 - DNA, 201 bp, Homo sapiens; identical to SEQ ID NO: 41623

SEQ ID NO: 71632 - DNA, 201 bp, Homo sapiens; identical to SEQ ID NO: 41624

SEQ ID NO: 71633 - DNA, 201 bp, Homo sapiens; identical to SEQ ID NO: 41625

SEQ ID NO: 71634 - DNA, 201 bp, Homo sapiens; identical to SEQ ID NO: 40928

SEQ ID NO: 71635 - DNA, 201 bp, Homo sapiens; identical to SEQ ID NO: 40930

SEQ ID NO: 71636 - DNA, 201 bp, Homo sapiens; identical to SEQ ID NO: 43131

SEQ ID NO: 71637 - DNA, 201 bp, Homo sapiens; identical to SEQ ID NO: 40932

SEQ ID NO: 71638 - DNA, 201 bp, Homo sapiens; identical to SEQ ID NO: 43134

SEQ ID NO: 71639 - DNA, 201 bp, Homo sapiens; identical to SEQ ID NO: 40933

SEQ ID NO: 71640 - DNA, 201 bp, Homo sapiens; identical to SEQ ID NO: 43135

SEQ ID NO: 71641 - DNA, 201 bp, Homo sapiens; identical to SEQ ID NO: 43136

SEQ ID NO: 71642 - DNA, 201 bp, Homo sapiens; identical to SEQ ID NO: 43137

SEQ ID NO: 71643 - DNA, 201 bp, Homo sapiens; identical to SEQ ID NO: 43139

SEQ ID NO: 71644 - DNA, 201 bp, Homo sapiens; identical to SEQ ID NO: 43140

SEQ ID NO: 71645 - DNA, 201 bp, Homo sapiens; identical to SEQ ID NO: 43141

SEQ ID NO: 71646 - DNA, 201 bp, Homo sapiens; identical to SEQ ID NO: 43148

SEQ ID NO: 71647 - DNA, 201 bp, Homo sapiens; identical to SEQ ID NO: 42124

SEQ ID NO: 71648 - DNA, 201 bp, Homo sapiens; identical to SEQ ID NO: 40937

SEQ ID NO: 71649 - DNA, 201 bp, Homo sapiens; identical to SEQ ID NO: 40938

SEQ ID NO: 71650 - DNA, 201 bp, Homo sapiens; identical to SEQ ID NO: 40939

SEQ ID NO: 71651 - DNA, 201 bp, Homo sapiens; identical to SEQ ID NO: 43165

SEQ ID NO: 71652 - DNA, 201 bp, Homo sapiens; identical to SEQ ID NO: 43166

SEQ ID NO: 71653 - DNA, 201 bp, Homo sapiens; identical to SEQ ID NO: 40940

SEQ ID NO: 71654 - DNA, 201 bp, Homo sapiens; identical to SEQ ID NO: 40941

SEQ ID NO: 71655 - DNA, 201 bp, Homo sapiens; identical to SEQ ID NO: 40942

SEQ ID NO: 71656 - DNA, 201 bp, Homo sapiens; identical to SEQ ID NO: 41650

SEQ ID NO: 71657 - DNA, 201 bp, Homo sapiens; identical to SEQ ID NO: 38375

SEQ ID NO: 71658 - DNA, 201 bp, Homo sapiens; identical to SEQ ID NO: 38376

SEQ ID NO: 71659 - DNA, 201 bp, Homo sapiens; identical to SEQ ID NO: 43190

SEQ ID NO: 71660 - DNA, 201 bp, Homo sapiens; identical to SEQ ID NO: 40948

SEQ ID NO: 71661 - DNA, 201 bp, Homo sapiens; identical to SEQ ID NO: 40949

SEQ ID NO: 71662 - DNA, 201 bp, Homo sapiens; identical to SEQ ID NO: 40950

SEQ ID NO: 71663 - DNA, 201 bp, Homo sapiens; identical to SEQ ID NO: 38394

SEQ ID NO: 71664 - DNA, 201 bp, Homo sapiens; identical to SEQ ID NO: 43201

SEQ ID NO: 71665 - DNA, 201 bp, Homo sapiens; identical to SEQ ID NO: 43204

SEQ ID NO: 71666 - DNA, 201 bp, Homo sapiens; identical to SEQ ID NO: 43207

SEQ ID NO: 71667 - DNA, 201 bp, Homo sapiens; identical to SEQ ID NO: 42722

SEQ ID NO: 71668 - DNA, 201 bp, Homo sapiens; identical to SEQ ID NO: 40045

SEQ ID NO: 71669 - DNA, 201 bp, Homo sapiens; identical to SEQ ID NO: 42154

SEQ ID NO: 71670 - DNA, 201 bp, Homo sapiens; identical to SEQ ID NO: 38398

SEQ ID NO: 71671 - DNA, 201 bp, Homo sapiens; identical to SEQ ID NO: 43218

SEQ ID NO: 71672 - DNA, 201 bp, Homo sapiens; identical to SEQ ID NO: 38399

SEQ ID NO: 71673 - DNA, 201 bp, Homo sapiens; identical to SEQ ID NO: 43222

SEQ ID NO: 71674 - DNA, 201 bp, Homo sapiens; identical to SEQ ID NO: 43225

SEQ ID NO: 71675 - DNA, 201 bp, Homo sapiens; identical to SEQ ID NO: 43227

SEQ ID NO: 71676 - DNA, 201 bp, Homo sapiens; identical to SEQ ID NO: 43231

SEQ ID NO: 71677 - DNA, 201 bp, Homo sapiens; identical to SEQ ID NO: 43232

SEQ ID NO: 71678 - DNA, 201 bp, Homo sapiens; identical to SEQ ID NO: 38401

SEQ ID NO: 71679 - DNA, 201 bp, Homo sapiens; identical to SEQ ID NO: 38403

SEQ ID NO: 71680 - DNA, 201 bp, Homo sapiens; identical to SEQ ID NO: 43234

SEQ ID NO: 71681 - DNA, 201 bp, Homo sapiens; identical to SEQ ID NO: 40968

SEQ ID NO: 71682 - DNA, 201 bp, Homo sapiens; identical to SEQ ID NO: 38411

SEQ ID NO: 71683 - DNA, 201 bp, Homo sapiens; identical to SEQ ID NO: 43240

SEQ ID NO: 71684 - DNA, 201 bp, Homo sapiens; identical to SEQ ID NO: 38416

SEQ ID NO: 71685 - DNA, 201 bp, Homo sapiens; identical to SEQ ID NO: 42742

SEQ ID NO: 71686 - DNA, 201 bp, Homo sapiens; identical to SEQ ID NO: 43253
  misc_feature (1)...(201): n = A,T,C or G, or insertion/deletion polymorphism (see Tables 1-2)

SEQ ID NO: 71687 - DNA, 201 bp, Homo sapiens; identical to SEQ ID NO: 43255

SEQ ID NO: 71688 - DNA, 201 bp, Homo sapiens; identical to SEQ ID NO: 43257

SEQ ID NO: 71689 - DNA, 201 bp, Homo sapiens; identical to SEQ ID NO: 40973

SEQ ID NO: 71690 - DNA, 201 bp, Homo sapiens; identical to SEQ ID NO: 42175

SEQ ID NO: 71691 - DNA, 201 bp, Homo sapiens; identical to SEQ ID NO: 43269

SEQ ID NO: 71692 - DNA, 201 bp, Homo sapiens; identical to SEQ ID NO: 38428

SEQ ID NO: 71693 - DNA, 201 bp, Homo sapiens; identical to SEQ ID NO: 42178

SEQ ID NO: 71694 - DNA, 201 bp, Homo sapiens; identical to SEQ ID NO: 43271

SEQ ID NO: 71695 - DNA, 201 bp, Homo sapiens; identical to SEQ ID NO: 38430

SEQ ID NO: 71696 - DNA, 201 bp, Homo sapiens; identical to SEQ ID NO: 43272

SEQ ID NO: 71697 - DNA, 201 bp, Homo sapiens; identical to SEQ ID NO: 43274

SEQ ID NO: 71698 - DNA, 201 bp, Homo sapiens; identical to SEQ ID NO: 42179

SEQ ID NO: 71699 - DNA, 201 bp, Homo sapiens; identical to SEQ ID NO: 43279

SEQ ID NO: 71700 - DNA, 201 bp, Homo sapiens; identical to SEQ ID NO: 42768

SEQ ID NO: 71701 - DNA, 201 bp, Homo sapiens; identical to SEQ ID NO: 42769

SEQ ID NO: 71702 - DNA, 201 bp, Homo sapiens; identical to SEQ ID NO: 38448

SEQ ID NO: 71703 - DNA, 201 bp, Homo sapiens; identical to SEQ ID NO: 42770

SEQ ID NO: 71704 - DNA, 201 bp, Homo sapiens; identical to SEQ ID NO: 38449

SEQ ID NO: 71705 - DNA, 201 bp, Homo sapiens; identical to SEQ ID NO: 38457

SEQ ID NO: 71706 - DNA, 201 bp, Homo sapiens; identical to SEQ ID NO: 38466

SEQ ID NO: 71707 - DNA, 201 bp, Homo sapiens; identical to SEQ ID NO: 38469

SEQ ID NO: 71708 - DNA, 201 bp, Homo sapiens; identical to SEQ ID NO: 38468

SEQ ID NO: 71709 - DNA, 201 bp, Homo sapiens; identical to SEQ ID NO: 43307

SEQ ID NO: 71710 - DNA, 201 bp, Homo sapiens; identical to SEQ ID NO: 43309

SEQ ID NO: 71711 - DNA, 201 bp, Homo sapiens; identical to SEQ ID NO: 39276

SEQ ID NO: 71712 - DNA, 201 bp, Homo sapiens; identical to SEQ ID NO: 42809

SEQ ID NO: 71713 - DNA, 201 bp, Homo sapiens; identical to SEQ ID NO: 42810

SEQ ID NO: 71714 - DNA, 201 bp, Homo sapiens; identical to SEQ ID NO: 42812

SEQ ID NO: 71715 - DNA, 201 bp, Homo sapiens; identical to SEQ ID NO: 42813

SEQ ID NO: 71716 - DNA, 201 bp, Homo sapiens; identical to SEQ ID NO: 42814

SEQ ID NO: 71717 - DNA, 201 bp, Homo sapiens; identical to SEQ ID NO: 42815

SEQ ID NO: 71718 - DNA, 201 bp, Homo sapiens; identical to SEQ ID NO: 42817

SEQ ID NO: 71719 - DNA, 201 bp, Homo sapiens; identical to SEQ ID NO: 42820

SEQ ID NO: 71720 - DNA, 201 bp, Homo sapiens; identical to SEQ ID NO: 42822

SEQ ID NO: 71721 - DNA, 201 bp, Homo sapiens; identical to SEQ ID NO: 42824

SEQ ID NO: 71722 - DNA, 201 bp, Homo sapiens; identical to SEQ ID NO: 38488

SEQ ID NO: 71723 - DNA, 201 bp, Homo sapiens; identical to SEQ ID NO: 43327

SEQ ID NO: 71724 - DNA, 201 bp, Homo sapiens; identical to SEQ ID NO: 43329

SEQ ID NO: 71725 - DNA, 201 bp, Homo sapiens; identical to SEQ ID NO: 43331

SEQ ID NO: 71726 - DNA, 201 bp, Homo sapiens; identical to SEQ ID NO: 43335

SEQ ID NO: 71727 - DNA, 201 bp, Homo sapiens; identical to SEQ ID NO: 43337

SEQ ID NO: 71728 - DNA, 201 bp, Homo sapiens; identical to SEQ ID NO: 42858

SEQ ID NO: 71729 - DNA, 201 bp, Homo sapiens; identical to SEQ ID NO: 42860

SEQ ID NO: 71730 - DNA, 201 bp, Homo sapiens; identical to SEQ ID NO: 42861

SEQ ID NO: 71731 - DNA, 201 bp, Homo sapiens; identical to SEQ ID NO: 42862

SEQ ID NO: 71732 - DNA, 201 bp, Homo sapiens; identical to SEQ ID NO: 42864

SEQ ID NO: 71733 - DNA, 201 bp, Homo sapiens; identical to SEQ ID NO: 42863

SEQ ID NO: 71734 - DNA, 201 bp, Homo sapiens; identical to SEQ ID NO: 42866

SEQ ID NO: 71735 - DNA, 201 bp, Homo sapiens; identical to SEQ ID NO: 42867

SEQ ID NO: 71736 - DNA, 201 bp, Homo sapiens; identical to SEQ ID NO: 42868

SEQ ID NO: 71737 - DNA, 201 bp, Homo sapiens; identical to SEQ ID NO: 42870

SEQ ID NO: 71738 - DNA, 201 bp, Homo sapiens; identical to SEQ ID NO: 42871

SEQ ID NO: 71739 - DNA, 201 bp, Homo sapiens; identical to SEQ ID NO: 43349

SEQ ID NO: 71740 - DNA, 201 bp, Homo sapiens; identical to SEQ ID NO: 42874

SEQ ID NO: 71741 - DNA, 201 bp, Homo sapiens; identical to SEQ ID NO: 39346

SEQ ID NO: 71742 - DNA, 201 bp, Homo sapiens; identical to SEQ ID NO: 43361

SEQ ID NO: 71743 - DNA, 201 bp, Homo sapiens; identical to SEQ ID NO: 43362

SEQ ID NO: 71744 - DNA, 201 bp, Homo sapiens; identical to SEQ ID NO: 43363

SEQ ID NO: 71745 - DNA, 201 bp, Homo sapiens; identical to SEQ ID NO: 42890

SEQ ID NO: 71746 - DNA, 201 bp, Homo sapiens; identical to SEQ ID NO: 42891

SEQ ID NO: 71747 - DNA, 201 bp, Homo sapiens; identical to SEQ ID NO: 38538

SEQ ID NO: 71748 - DNA, 201 bp, Homo sapiens; identical to SEQ ID NO: 38539

SEQ ID NO: 71749 - DNA, 201 bp, Homo sapiens; identical to SEQ ID NO: 41023

SEQ ID NO: 71750 - DNA, 201 bp, Homo sapiens; identical to SEQ ID NO: 43383

SEQ ID NO: 71751 - DNA, 201 bp, Homo sapiens; identical to SEQ ID NO: 43386

SEQ ID NO: 71752 - DNA, 201 bp, Homo sapiens; identical to SEQ ID NO: 38552

SEQ ID NO: 71753 - DNA, 201 bp, Homo sapiens; identical to SEQ ID NO: 43388

SEQ ID NO: 71754 - DNA, 201 bp, Homo sapiens; identical to SEQ ID NO: 42198

SEQ ID NO: 71755 - DNA, 201 bp, Homo sapiens; identical to SEQ ID NO: 42199

SEQ ID NO: 71756 - DNA, 201 bp, Homo sapiens; identical to SEQ ID NO: 42200

SEQ ID NO: 71757 - DNA, 201 bp, Homo sapiens; identical to SEQ ID NO: 42201

SEQ ID NO: 71758 - DNA, 201 bp, Homo sapiens; identical to SEQ ID NO: 42202

SEQ ID NO: 71759 - DNA, 201 bp, Homo sapiens; identical to SEQ ID NO: 42203

SEQ ID NO: 71760 - DNA, 201 bp, Homo sapiens; identical to SEQ ID NO: 42204

SEQ ID NO: 71761 - DNA, 201 bp, Homo sapiens; identical to SEQ ID NO: 43401

SEQ ID NO: 71762 - DNA, 201 bp, Homo sapiens; identical to SEQ ID NO: 39406

SEQ ID NO: 71763 - DNA, 201 bp, Homo sapiens; identical to SEQ ID NO: 43403

SEQ ID NO: 71764 - DNA, 201 bp, Homo sapiens; identical to SEQ ID NO: 42909

SEQ ID NO: 71765 - DNA, 201 bp, Homo sapiens; identical to SEQ ID NO: 39418

SEQ ID NO: 71766 - DNA, 201 bp, Homo sapiens; identical to SEQ ID NO: 38584

SEQ ID NO: 71767 - DNA, 201 bp, Homo sapiens; identical to SEQ ID NO: 38585

SEQ ID NO: 71768 - DNA, 201 bp, Homo sapiens; identical to SEQ ID NO: 41737

SEQ ID NO: 71769 - DNA, 201 bp, Homo sapiens; identical to SEQ ID NO: 38588

SEQ ID NO: 71770 - DNA, 201 bp, Homo sapiens; identical to SEQ ID NO: 38591

SEQ ID NO: 71771 - DNA, 201 bp, Homo sapiens; identical to SEQ ID NO: 39427

SEQ ID NO: 71772 - DNA, 201 bp, Homo sapiens; identical to SEQ ID NO: 38593

SEQ ID NO: 71773 - DNA, 201 bp, Homo sapiens; identical to SEQ ID NO: 42211

SEQ ID NO: 71774 - DNA, 201 bp, Homo sapiens; identical to SEQ ID NO: 39428

SEQ ID NO: 71775 - DNA, 201 bp, Homo sapiens; identical to SEQ ID NO: 38600

SEQ ID NO: 71776 - DNA, 201 bp, Homo sapiens; identical to SEQ ID NO: 38601

SEQ ID NO: 71777 - DNA, 201 bp, Homo sapiens; identical to SEQ ID NO: 43415

SEQ ID NO: 71778 - DNA, 201 bp, Homo sapiens; identical to SEQ ID NO: 43418

SEQ ID NO: 71779 - DNA, 201 bp, Homo sapiens; identical to SEQ ID NO: 43419

SEQ ID NO: 71780 - DNA, 201 bp, Homo sapiens; identical to SEQ ID NO: 42212

SEQ ID NO: 71781 - DNA, 201 bp, Homo sapiens; identical to SEQ ID NO: 39433

SEQ ID NO: 71782 - DNA, 201 bp, Homo sapiens; identical to SEQ ID NO: 42213

SEQ ID NO: 71783 - DNA, 201 bp, Homo sapiens; identical to SEQ ID NO: 38605

SEQ ID NO: 71784 - DNA, 201 bp, Homo sapiens; identical to SEQ ID NO: 42214

SEQ ID NO: 71785 - DNA, 201 bp, Homo sapiens; identical to SEQ ID NO: 42215

SEQ ID NO: 71786 - DNA, 201 bp, Homo sapiens; identical to SEQ ID NO: 42910

SEQ ID NO: 71787 - DNA, 201 bp, Homo sapiens; identical to SEQ ID NO: 43425

SEQ ID NO: 71788 - DNA, 201 bp, Homo sapiens; identical to SEQ ID NO: 41742

SEQ ID NO: 71789 - DNA, 201 bp, Homo sapiens; identical to SEQ ID NO: 42216

SEQ ID NO: 71790 - DNA, 201 bp, Homo sapiens; identical to SEQ ID NO: 38624

SEQ ID NO: 71791 - DNA, 201 bp, Homo sapiens; identical to SEQ ID NO: 38627

SEQ ID NO: 71792 - DNA, 201 bp, Homo sapiens; identical to SEQ ID NO: 38629

SEQ ID NO: 71793 - DNA, 201 bp, Homo sapiens; identical to SEQ ID NO: 41748

SEQ ID NO: 71794 - DNA, 201 bp, Homo sapiens; identical to SEQ ID NO: 40189

SEQ ID NO: 71795 - DNA, 201 bp, Homo sapiens; identical to SEQ ID NO: 41035

SEQ ID NO: 71796 - DNA, 201 bp, Homo sapiens; identical to SEQ ID NO: 43445

SEQ ID NO: 71797 - DNA, 201 bp, Homo sapiens; identical to SEQ ID NO: 43448

SEQ ID NO: 71798 - DNA, 201 bp, Homo sapiens; identical to SEQ ID NO: 41036

SEQ ID NO: 71799 - DNA, 201 bp, Homo sapiens; identical to SEQ ID NO: 41037

SEQ ID NO: 71800 - DNA, 201 bp, Homo sapiens; identical to SEQ ID NO: 39460

SEQ ID NO: 71801 - DNA, 201 bp, Homo sapiens; identical to SEQ ID NO: 38637

SEQ ID NO: 71802 - DNA, 201 bp, Homo sapiens; identical to SEQ ID NO: 42921

SEQ ID NO: 71803 - DNA, 201 bp, Homo sapiens; identical to SEQ ID NO: 38639

SEQ ID NO: 71804 - DNA, 201 bp, Homo sapiens; identical to SEQ ID NO: 42225

SEQ ID NO: 71805 - DNA, 201 bp, Homo sapiens; identical to SEQ ID NO: 42922

SEQ ID NO: 71806 - DNA, 201 bp, Homo sapiens; identical to SEQ ID NO: 42226

SEQ ID NO: 71807 - DNA, 201 bp, Homo sapiens; identical to SEQ ID NO: 42227

SEQ ID NO: 71808 - DNA, 201 bp, Homo sapiens; identical to SEQ ID NO: 42228

SEQ ID NO: 71809 - DNA, 201 bp, Homo sapiens; identical to SEQ ID NO: 42229

SEQ ID NO: 71810 - DNA, 201 bp, Homo sapiens; identical to SEQ ID NO: 42230

SEQ ID NO: 71811 - DNA, 201 bp, Homo sapiens; identical to SEQ ID NO: 42231

SEQ ID NO: 71812 - DNA, 201 bp, Homo sapiens; identical to SEQ ID NO: 42232

SEQ ID NO: 71813 - DNA, 201 bp, Homo sapiens; identical to SEQ ID NO: 42233

SEQ ID NO: 71814 - DNA, 201 bp, Homo sapiens; identical to SEQ ID NO: 38658

SEQ ID NO: 71815 - DNA, 201 bp, Homo sapiens; identical to SEQ ID NO: 38661

SEQ ID NO: 71816 - DNA, 201 bp, Homo sapiens; identical to SEQ ID NO: 38664

SEQ ID NO: 71817 - DNA, 201 bp, Homo sapiens; identical to SEQ ID NO: 38663

SEQ ID NO: 71818 - DNA, 201 bp, Homo sapiens; identical to SEQ ID NO: 38670

SEQ ID NO: 71819 - DNA, 201 bp, Homo sapiens; identical to SEQ ID NO: 39494

SEQ ID NO: 71820 - DNA, 201 bp, Homo sapiens; identical to SEQ ID NO: 38673

SEQ ID NO: 71821 - DNA, 201 bp, Homo sapiens; identical to SEQ ID NO: 38674

SEQ ID NO: 71822 - DNA, 201 bp, Homo sapiens; identical to SEQ ID NO: 39496

SEQ ID NO: 71823 - DNA, 201 bp, Homo sapiens; identical to SEQ ID NO: 43457

SEQ ID NO: 71824 - DNA, 201 bp, Homo sapiens; identical to SEQ ID NO: 43458

SEQ ID NO: 71825 - DNA, 201 bp, Homo sapiens; identical to SEQ ID NO: 43460

SEQ ID NO: 71826 - DNA, 201 bp, Homo sapiens; identical to SEQ ID NO: 39503

SEQ ID NO: 71827 - DNA, 201 bp, Homo sapiens; identical to SEQ ID NO: 41039

SEQ ID NO: 71828 - DNA, 201 bp, Homo sapiens; identical to SEQ ID NO: 38682

SEQ ID NO: 71829 - DNA, 201 bp, Homo sapiens; identical to SEQ ID NO: 42240

SEQ ID NO: 71830 - DNA, 201 bp, Homo sapiens; identical to SEQ ID NO: 38685

SEQ ID NO: 71831 - DNA, 201 bp, Homo sapiens; identical to SEQ ID NO: 42242

SEQ ID NO: 71832 - DNA, 201 bp, Homo sapiens; identical to SEQ ID NO: 42243

SEQ ID NO: 71833 - DNA, 201 bp, Homo sapiens; identical to SEQ ID NO: 42244

SEQ ID NO: 71834 - DNA, 201 bp, Homo sapiens; identical to SEQ ID NO: 42246

SEQ ID NO: 71835 - DNA, 201 bp, Homo sapiens; identical to SEQ ID NO: 42247

SEQ ID NO: 71836 - DNA, 201 bp, Homo sapiens; identical to SEQ ID NO: 39507

SEQ ID NO: 71837 - DNA, 201 bp, Homo sapiens; identical to SEQ ID NO: 39509

SEQ ID NO: 71838 - DNA, 201 bp, Homo sapiens; identical to SEQ ID NO: 42248

SEQ ID NO: 71839 - DNA, 201 bp, Homo sapiens; identical to SEQ ID NO: 42249

SEQ ID NO: 71840 - DNA, 201 bp, Homo sapiens; identical to SEQ ID NO: 42936

SEQ ID NO: 71841 - DNA, 201 bp, Homo sapiens; identical to SEQ ID NO: 41779

SEQ ID NO: 71842 - DNA, 201 bp, Homo sapiens; identical to SEQ ID NO: 42937

SEQ ID NO: 71843 - DNA, 201 bp, Homo sapiens; identical to SEQ ID NO: 41780

SEQ ID NO: 71844 - DNA, 201 bp, Homo sapiens; identical to SEQ ID NO: 42939

SEQ ID NO: 71845 - DNA, 201 bp, Homo sapiens; identical to SEQ ID NO: 41783

SEQ ID NO: 71846 - DNA, 201 bp, Homo sapiens; identical to SEQ ID NO: 39518

SEQ ID NO: 71847 - DNA, 201 bp, Homo sapiens; identical to SEQ ID NO: 39521

SEQ ID NO: 71848 - DNA, 201 bp, Homo sapiens; identical to SEQ ID NO: 38696

SEQ ID NO: 71849 - DNA, 201 bp, Homo sapiens; identical to SEQ ID NO: 39525

SEQ ID NO: 71850 - DNA, 201 bp, Homo sapiens; identical to SEQ ID NO: 40246

SEQ ID NO: 71851 - DNA, 201 bp, Homo sapiens; identical to SEQ ID NO: 39534

SEQ ID NO: 71852 - DNA, 201 bp, Homo sapiens; identical to SEQ ID NO: 38701

SEQ ID NO: 71853 - DNA, 201 bp, Homo sapiens; identical to SEQ ID NO: 39538

SEQ ID NO: 71854 - DNA, 201 bp, Homo sapiens; identical to SEQ ID NO: 39539

SEQ ID NO: 71855 - DNA, 201 bp, Homo sapiens; identical to SEQ ID NO: 39541

SEQ ID NO: 71856 - DNA, 201 bp, Homo sapiens; identical to SEQ ID NO: 41050

SEQ ID NO: 71857 - DNA, 201 bp, Homo sapiens; identical to SEQ ID NO: 39543

SEQ ID NO: 71858 - DNA, 201 bp, Homo sapiens; identical to SEQ ID NO: 41785

SEQ ID NO: 71859 - DNA, 201 bp, Homo sapiens; identical to SEQ ID NO: 41786

SEQ ID NO: 71860 - DNA, 201 bp, Homo sapiens; identical to SEQ ID NO: 41051

SEQ ID NO: 71861 - DNA, 201 bp, Homo sapiens; identical to SEQ ID NO: 38711

SEQ ID NO: 71862 - DNA, 201 bp, Homo sapiens; identical to SEQ ID NO: 43478

SEQ ID NO: 71863 - DNA, 201 bp, Homo sapiens; identical to SEQ ID NO: 38712

SEQ ID NO: 71864 - DNA, 201 bp, Homo sapiens; identical to SEQ ID NO: 41787

SEQ ID NO: 71865 - DNA, 201 bp, Homo sapiens; identical to SEQ ID NO: 38714

SEQ ID NO: 71866 - DNA, 201 bp, Homo sapiens; identical to SEQ ID NO: 43482

SEQ ID NO: 71867 - DNA, 201 bp, Homo sapiens; identical to SEQ ID NO: 38715

SEQ ID NO: 71868 - DNA, 201 bp, Homo sapiens; identical to SEQ ID NO: 38716

SEQ ID NO: 71869 - DNA, 201 bp, Homo sapiens; identical to SEQ ID NO: 43485

SEQ ID NO: 71870 - DNA, 201 bp, Homo sapiens; identical to SEQ ID NO: 38717

SEQ ID NO: 71871 - DNA, 201 bp, Homo sapiens; identical to SEQ ID NO: 38719

SEQ ID NO: 71872 - DNA, 201 bp, Homo sapiens; identical to SEQ ID NO: 41788

SEQ ID NO: 71873 - DNA, 201 bp, Homo sapiens; identical to SEQ ID NO: 41052

SEQ ID NO: 71874 - DNA, 201 bp, Homo sapiens; identical to SEQ ID NO: 38722

SEQ ID NO: 71875 - DNA, 201 bp, Homo sapiens; identical to SEQ ID NO: 41054

SEQ ID NO: 71876 - DNA, 201 bp, Homo sapiens; identical to SEQ ID NO: 43491

SEQ ID NO: 71877 - DNA, 201 bp, Homo sapiens; identical to SEQ ID NO: 42256

SEQ ID NO: 71878 - DNA, 201 bp, Homo sapiens; identical to SEQ ID NO: 42257

SEQ ID NO: 71879 - DNA, 201 bp, Homo sapiens; identical to SEQ ID NO: 39552

SEQ ID NO: 71880 - DNA, 201 bp, Homo sapiens; identical to SEQ ID NO: 43493

SEQ ID NO: 71881 - DNA, 201 bp, Homo sapiens; identical to SEQ ID NO: 42258

SEQ ID NO: 71882 - DNA, 201 bp, Homo sapiens; identical to SEQ ID NO: 38730

SEQ ID NO: 71883 - DNA, 201 bp, Homo sapiens; identical to SEQ ID NO: 39553

SEQ ID NO: 71884 - DNA, 201 bp, Homo sapiens; identical to SEQ ID NO: 42259

SEQ ID NO: 71885 - DNA, 201 bp, Homo sapiens; identical to SEQ ID NO: 39554

SEQ ID NO: 71886 - DNA, 201 bp, Homo sapiens; identical to SEQ ID NO: 42260

SEQ ID NO: 71887 - DNA, 201 bp, Homo sapiens; identical to SEQ ID NO: 42261

SEQ ID NO: 71888 - DNA, 201 bp, Homo sapiens; identical to SEQ ID NO: 42262

SEQ ID NO: 71889 - DNA, 201 bp, Homo sapiens; identical to SEQ ID NO: 42263

SEQ ID NO: 71890 - DNA, 201 bp, Homo sapiens; identical to SEQ ID NO: 42264

SEQ ID NO: 71891 - DNA, 201 bp, Homo sapiens; identical to SEQ ID NO: 39555

SEQ ID NO: 71892 - DNA, 201 bp, Homo sapiens; identical to SEQ ID NO: 39556

SEQ ID NO: 71893 - DNA, 201 bp, Homo sapiens; identical to SEQ ID NO: 39557

SEQ ID NO: 71894 - DNA, 201 bp, Homo sapiens; identical to SEQ ID NO: 39559

SEQ ID NO: 71895 - DNA, 201 bp, Homo sapiens; identical to SEQ ID NO: 39560

SEQ ID NO: 71896 - DNA, 201 bp, Homo sapiens; identical to SEQ ID NO: 39561

SEQ ID NO: 71897 - DNA, 201 bp, Homo sapiens; identical to SEQ ID NO: 39562

SEQ ID NO: 71898 - DNA, 201 bp, Homo sapiens; identical to SEQ ID NO: 42948

SEQ ID NO: 71899 - DNA, 201 bp, Homo sapiens; identical to SEQ ID NO: 39565

SEQ ID NO: 71900 - DNA, 201 bp, Homo sapiens; identical to SEQ ID NO: 43501

SEQ ID NO: 71901 - DNA, 201 bp, Homo sapiens; identical to SEQ ID NO: 39572

SEQ ID NO: 71902 - DNA, 201 bp, Homo sapiens; identical to SEQ ID NO: 39575

SEQ ID NO: 71903 - DNA, 201 bp, Homo sapiens; identical to SEQ ID NO: 39581

SEQ ID NO: 71904 - DNA, 201 bp, Homo sapiens; identical to SEQ ID NO: 39583

SEQ ID NO: 71905 - DNA, 201 bp, Homo sapiens; identical to SEQ ID NO: 39587

SEQ ID NO: 71906 - DNA, 201 bp, Homo sapiens; identical to SEQ ID NO: 41075

SEQ ID NO: 71907 - DNA, 201 bp, Homo sapiens; identical to SEQ ID NO: 41807

SEQ ID NO: 71908 - DNA, 201 bp, Homo sapiens; identical to SEQ ID NO: 42274

SEQ ID NO: 71909 - DNA, 201 bp, Homo sapiens; identical to SEQ ID NO: 39592

SEQ ID NO: 71910 - DNA, 201 bp, Homo sapiens; identical to SEQ ID NO: 38757

SEQ ID NO: 71911 - DNA, 201 bp, Homo sapiens; identical to SEQ ID NO: 43508

SEQ ID NO: 71912 - DNA, 201 bp, Homo sapiens; identical to SEQ ID NO: 39591

SEQ ID NO: 71913 - DNA, 201 bp, Homo sapiens; identical to SEQ ID NO: 41809

SEQ ID NO: 71914 - DNA, 201 bp, Homo sapiens; identical to SEQ ID NO: 39593

SEQ ID NO: 71915 - DNA, 201 bp, Homo sapiens; identical to SEQ ID NO: 41076

SEQ ID NO: 71916 - DNA, 201 bp, Homo sapiens; identical to SEQ ID NO: 38759

SEQ ID NO: 71917 - DNA, 201 bp, Homo sapiens; identical to SEQ ID NO: 39595

SEQ ID NO: 71918 - DNA, 201 bp, Homo sapiens; identical to SEQ ID NO: 41077

SEQ ID NO: 71919 - DNA, 201 bp, Homo sapiens; identical to SEQ ID NO: 41078

SEQ ID NO: 71920 - DNA, 201 bp, Homo sapiens; identical to SEQ ID NO: 41079

SEQ ID NO: 71921 - DNA, 201 bp, Homo sapiens; identical to SEQ ID NO: 41080

SEQ ID NO: 71922 - DNA, 201 bp, Homo sapiens; identical to SEQ ID NO: 42279

SEQ ID NO: 71923 - DNA, 201 bp, Homo sapiens; identical to SEQ ID NO: 42280

SEQ ID NO: 71924 - DNA, 201 bp, Homo sapiens; identical to SEQ ID NO: 42281

SEQ ID NO: 71925 - DNA, 201 bp, Homo sapiens; identical to SEQ ID NO: 40300

SEQ ID NO: 71926 - DNA, 201 bp, Homo sapiens; identical to SEQ ID NO: 42282

SEQ ID NO: 71927 - DNA, 201 bp, Homo sapiens; identical to SEQ ID NO: 38775

SEQ ID NO: 71928 - DNA, 201 bp, Homo sapiens; identical to SEQ ID NO: 42283

SEQ ID NO: 71929 - DNA, 201 bp, Homo sapiens; identical to SEQ ID NO: 39602

SEQ ID NO: 71930 - DNA, 201 bp, Homo sapiens; identical to SEQ ID NO: 42953

SEQ ID NO: 71931 - DNA, 201 bp, Homo sapiens; identical to SEQ ID NO: 39606

SEQ ID NO: 71932 - DNA, 201 bp, Homo sapiens; identical to SEQ ID NO: 39609

SEQ ID NO: 71933 - DNA, 201 bp, Homo sapiens
ttaatttattttaacattacagaggctaaaaatgtaattaagctcaagcaacatttaccattttatctgatagaatagaatattatattagctattcatgytttttaaacttacacaatcaaagatactgccaacacacaatattttttaaagcccagtttcaaaatttagatttccctagggaaccctgagtgcattcat

SEQ ID NO: 71934 - DNA, 201 bp, Homo sapiens
ttgcctcaaaatcatgtgaggtacctgagtaagtgttagtccctactgcaatccaaccgaattggaatctcaggggaaggggcgataaacccagatttttmatgttgtcctcccacaacccttgcacttaattattatgtatgttaatgtttgggaatctctattcaagagaatgtgtataatttcaagccaattaattta

SEQ ID NO: 71935 - DNA, 201 bp, Homo sapiens
actatcagtaatggtattatcgtgaatacagctactagaatttaagttacaatgactaagagtaaataaactcctttacggcagtgtttcttgaagtgtgstccattgactacttgcctcaaaatcatgtgaggtacctgagtaagtgttagtccctactgcaatccaaccgaattggaatctcaggggaaggggcgataa

SEQ ID NO: 71936 - DNA, 201 bp, Homo sapiens
tcataaatttagatctttaatccattctgagttgactttgttcagtttagtcatatttaagagaaggaaagctacaggtgattgctactatcagtaatggyattatcgtgaatacagctactagaatttaagttacaatgactaagagtaaataaactcctttacggcagtgtttcttgaagtgtgctccattgactactt

SEQ ID NO: 71937 - DNA, 201 bp, Homo sapiens
catttgattttgatatgtatttctctgatgattagtgatgttgagcattttttatacacttgttgaccattggtatgtcttcttttgagaaatgtcttttsaagtccttggcccattttttaatcaggttatttggtttcttactactgagttgtataaatttcctatatatttttgatactaactaactccttacttgac

SEQ ID NO: 71938 - DNA, 201 bp, Homo sapiens
gaagttttcagtaggggaggaaaattgttctacaaaaggcaaaacaaaaatatctgaccagatccaatactaaagcaatgtattttaaatggagggagtcmtgacttttgaagtttatctgtttctatcctttgttttacaggaacagccagctgaaaactctcctggccattggaggctggaacttcgggactgccccgt

SEQ ID NO: 71939 - DNA, 201 bp, Homo sapiens
tttgatgccagacacaaaatgtccacaatagaaaatctgaccacagtatctaaacagttgcttatcagcccttggaactgccaaaaaagctattaaactgrtgttttccatggtgatggtctccaccaccctgttaggagccatgacattgttctgtccttgttgggcagagaaggtggtgatgctggtggtgggagggtg

SEQ ID NO: 71940 - DNA, 201 bp, Homo sapiens
gcaccagctgagaagctcatcgttggattccctacctatggacacaacttcatcctgagcaacccctccaacactggaattggtgcccccacctctggtgytggtcctgctgggccctatgccaaggagtctgggatctgggcttactacgaggtatgtagattggactgaaaagtgctctgtgaattccgtgcactgtgc

SEQ ID NO: 71941 - DNA, 201 bp, Homo sapiens
gttattttgctgaattcattttttagctctgacaaaatttttggtgtggaatctttagggtttttcctatataagaccacatctgcagggacaattttacyacttccttcccaaattggatgccttttatgtcttatttttgcccaaatgttctggttaagactatgttgaatagaagtggcaaaagaagcattcttatct

SEQ ID NO: 71942 - DNA, 201 bp, Homo sapiens
atcatttgggtagtatagacattttaacaatattgagtcttccaactcatgaacatggggcatgtttccatttattcatattttctttatttgaacagcakgctatagttttcattgtacaagtctttcacttcattaagttaatttctaagtattttattctttttgatgctattgtaaatgaaattatttttataattt

SEQ ID NO: 71943 - DNA, 201 bp, Homo sapiens
tatgatcatgccactgcactcgagcctgggtgacagagtgagaccctgtctcaaaaaacaatgacaacaaagaaaacatcactgggatttcgatagggatwgcattgaatctgtacatcatttgggtagtatagacattttaacaatattgagtcttccaactcatgaacatggggcatgtttccatttattcatattttc

SEQ ID NO: 71944 - DNA, 201 bp, Homo sapiens
tttcaggttgcacggctccagctcagcccattgagccaataactgctgctcccagtggcagcgggaacgggagcgggagtagcagctctggaggcagctcrggaggcagtggattctgtgctggcagagccaacggcctctaccccgtggcaaataacagaaatgccttctggcactgcgtgaatggagtcacgtaccagc

SEQ ID NO: 71945 - DNA, 201 bp, Homo sapiens
atgatatttgctgtgggtttttcaaacatagcttttattatattgaggtagtttgcttctatttctagtttgtttttattatgagagggtattaacttttrgcaaatactttttctgcatcaattgagatgattatgccatttttttcttcattcttttaatgtggtgtattacattcattggttttcataagttaaatca

SEQ ID NO: 71946 - DNA, 201 bp, Homo sapiens
tctttcaccattgagtatgatatttgctgtgggtttttcaaacatagcttttattatattgaggtagtttgcttctatttctagtttgtttttattatgasagggtattaacttttggcaaatactttttctgcatcaattgagatgattatgccatttttttcttcattcttttaatgtggtgtattacattcattggtt

SEQ ID NO: 71947 - DNA, 201 bp, Homo sapiens; identical to SEQ ID NO: 25115

SEQ ID NO: 71948 - DNA, 201 bp, Homo sapiens; identical to SEQ ID NO: 25117

SEQ ID NO: 71949 - DNA, 201 bp, Homo sapiens; identical to SEQ ID NO: 25119

SEQ ID NO: 71950 - DNA, 201 bp, Homo sapiens
tttgaacccatcacaaggaagctaacaattttgaaaaaaggttagacgaatggctaaccagaataaacagtgtagagaagaacttaaatgaactgacagarcggaaaaccatggcacgagaacttcgtgatgcatgcacaagcttcagtagctgatttgatcaaatggaagaaagggtatccgtgattgaagatcaaatta

SEQ ID NO: 71951 - DNA, 201 bp, Homo sapiens
cttaaaaatagtaattgtaataaatttatatttgaaacatgtaaggtatttaattcacacacaatgttttgtgtgcaaactcccctttcccctataattaytcctcagctatccaaggacttgaggtcttcagattgggaaaaataacattaactaaaatttattaaataactaacatgtgctaggcccagtgctaggtag

SEQ ID NO: 71952 - DNA, 201 bp, Homo sapiens
atccatatgtaatacatgaggaaattgaggttcacaggtgaaataacttgtctaatgtcacatatctagaaagaaggagaacaaaaattgaaatataagtyagcgattctagagaccatgctgatattctgttctgtcatatggcaacctttgtgctggacaggtgtgggagaatgctctctgcaattgactggcattggt

SEQ ID NO: 71953 - DNA, 201 bp, Homo sapiens
ctaactgccccaattaaaagacacagactggcaaattggataaagagtcaaggtccatcagtgtgctgtaatcaggagacccatctcatgtacaaagacayacataggctcaaaataaagagatggaggaagatctaccaagcaaatggaaagcaaaaaaaaaaaaaaaaaaaaacaagcaggggttgtaatcctagtctc

SEQ ID NO: 71954 - DNA, 201 bp, Homo sapiens
atctagaaagaaggagaacaaaaattgaaatataagtcagcgattctagagaccatgctgatattctgttctgtcatatggcaacctttgtgctggacagrtgtgggagaatgctctctgcaattgactggcattggttattctaacagtcttaccctctttgtatgtgaataaactggcattctcacttacattgactgc

SEQ ID NO: 71955 - DNA, 201 bp, Homo sapiens
acaataataatgggagactttaacaacccactgccaatattagacatatcaatgagacagaaggttaacaaggatatccaggacttgaactcagctctgcrctaagcagacctaatagacatctgcagaactctccaccccaaatcaacagaatatacattcttctcagcaccacatcacacttattccaaaattgaccac

SEQ ID NO: 71956 - DNA, 201 bp, Homo sapiens
aaaagaacagaaatcacaacaaactgtctctaagaccacagcgcaatcaaattagaactcaggattaagaaactcactcaaaaccgcaccactacatggaragtgaacaacctgctcctgaatgactactgggtaaataacgagatgaaggcagatataaagatgttctttgaaaccagtaagaacagagacacaacgtgc

SEQ ID NO: 71957 - DNA, 201 bp, Homo sapiens
aaaatcaacaccctaacatcacaattaaaagaactagagaagcaagagaaaacgcattcaaaagctagcagaaggtgagaaataactaagatcagagcagmactgaaagagacagagacacaaaaaacccctcaaaaaatcagtgaatccaagagatgcttttttgaaaagatcaacaaaattgatagactgctagcaaga

SEQ ID NO: 71958 - DNA, 201 bp, Homo sapiens
cttaggatgcatttgcaagagtgttcatactaattacctccacacagagatcaggcatctgaggcacagggagggaaacagaggcaaggccaaaactcacmgcacacttcagtggatcctaaaccaggccattgtccctcctgctgactacacacaggctctgcctaccagctgacatgctacttcaccaactgggcccag

SEQ ID NO: 71959 - DNA, 201 bp, Homo sapiens
tatttaaaaaatggtgctgggataactggctagccatatgtaggaagctgaacctggatcccttccttacaccttacacaaaaatttattcaagacagatkaaagacgtaaatattagacttaaaaccataaaaaccctagaggaaaacctaggcaataccattcaggacataggcatgggcaaggacttcatgactaaaa

SEQ ID NO: 71960 - DNA, 201 bp, Homo sapiens
ctgctgactacacacaggctctgcctaccagctgacatgctacttcaccaactgggcccagtaccggccaggcctggggcgcttcatgcctgacaacatcracccctgcctctgtacccacctgatctacgcctttgctgggaggcagaacaacgagatcaccaccatcgaatggaatgatgtgactctctaccaagcttt

SEQ ID NO: 71961 - DNA, 201 bp, Homo sapiens
taaacaggctcaatggcttaagcacaacaaatctggaggcgccatggtctgggccattgatctggatgacttcactggcactttctgcaaccagggcaagyttcccctaatctccaccctgaagaaggccctcggcctgcagagtgcaagtaagtgactgagggggaatgcccaggtgtataaataccccttctccaactc

SEQ ID NO: 71962 - DNA, 201 bp, Homo sapiens
catcgtactgttaccaaaacagatatatagaccaatggaacagaatagaggcctcagaaataacaccacacatctacaaccatctgatctttgacaaacckgacaaaaacaagaaatggtgaaaggattccctatttaaaaaatggtgctgggataactggctagccatatgtaggaagctgaacctggatcccttcctta

SEQ ID NO: 71963 - DNA, 201 bp, Homo sapiens
aatctcttgacttttgaaagatctgtaccttcctgaaaaatggagccactcagggatgggatgcccctcaggaagtgccttatgcctatcagggcaatgtrtgggttggctatgacaacgtcaagagcttcgatattaaggtaagatcagtcccttaaatgtgctgaggtcccagccctgagtcccaggaaagcaagtgat

SEQ ID NO: 71964 - DNA, 201 bp, Homo sapiens
aggcgccatggtctgggccattgatctggatgacttcactggcactttctgcaaccagggcaagtttcccctaatctccaccctgaagaaggccctcggcytgcagagtgcaagtaagtgactgagggggaatgcccaggtgtataaataccccttctccaactcaaaaagcaaccctgatgtcttcccacctcccccttg

SEQ ID NO: 71965 - DNA, 201 bp, Homo sapiens
cctgacttttgaagtttatctgtttctatcctttgttttacaggaacagccagctgaaaactctcctggccattggaggctggaacttcgggactgccccrtaagtcttctatggagagcatgttgttcgtttgctatggaaaacaagttagccccatgtgatcactgtccctttagacttcacaatctaagacagggtat

SEQ ID NO: 71966 - DNA, 201 bp, Homo sapiens
tcattataaggcaccataaagagagtgaaaaaataacccataaagttggaaaagatatgttcaatgcacgtaactgaaaaataattacaatccagaatatrtaaagcatggctataaaaattaataaacttgtgggcagcacaatagaaaaatgggcaaaagatacaagcaggcatttcacagaaaaggaaacaaaaacag

SEQ ID NO: 71967 - DNA, 201 bp, Homo sapiens
gagtgtgttgtttagtttccacaaattggtggcttctacagtttcacttctattatcaatttctaacttcacgtcctttgtggttggagaagatactttgyatgatctctatatttttaaatctgttgagacttaatttgtgacctaatatatagtctatactgaaaaatgtcccgtgtgcgcttgggaagaatgtaaatg

SEQ ID NO: 71968 - DNA, 201 bp, Homo sapiens
caagagaaaacgcattcaaaagctagcagaaggtgagaaataactaagatcagagcagaactgaaagagacagagacacaaaaaacccctcaaaaaatcartgaatccaagagatgcttttttgaaaagatcaacaaaattgatagactgctagcaagacttacaaagaagaaaagaaagaagaatcaaatagatgcaata

SEQ ID NO: 71969 - DNA, 201 bp, Homo sapiens
ttttcttgtttttcagtgtgaatatttagagttataaagttctcacttagtagtgccttcacagtatcccataagttttgctatgttatgtttttattttyattcatttctaagtatttttaaatttcccttatgactacttctttaatctattattaagagtgtgttgtttagtttccacaaattggtggcttctacagt

SEQ ID NO: 71970 - DNA, 201 bp, Homo sapiens
acgcattcaaaagctagcagaaggtgagaaataactaagatcagagcagaactgaaagagacagagacacaaaaaacccctcaaaaaatcagtgaatccargagatgcttttttgaaaagatcaacaaaattgatagactgctagcaagacttacaaagaagaaaagaaagaagaatcaaatagatgcaataaaaaatgat

SEQ ID NO: 71971 - DNA, 201 bp, Homo sapiens
tccctaactcattttatggggccaacatcatcctgataccaaagcctggcagacacaccacaaaaaaagagaattttagaccaatatccctgatgaccatygatgcaaaaatcctcaataaaatactggcaaaccaaatctggcagcatatcaaaaagcttatccaccacgatcaagttggcttcatccctgggatgcaag

SEQ ID NO: 71972 - DNA, 201 bp, Homo sapiens
aaactactttaaagttcatatggaaccaaaaaagagcccacattgccaagacaatcctaaggaaaaagaagaaagctggaggcatcatgctacttgacttmaaactatactacaaggctacagtaaccaaaacagcatcgtactgttaccaaaacagatatatagaccaatggaacagaatagaggcctcagaaataacac

SEQ ID NO: 71973 - DNA, 201 bp, Homo sapiens
cacattgccaagacaatcctaaggaaaaagaagaaagctggaggcatcatgctacttgacttcaaactatactacaaggctacagtaaccaaaacagcatsgtactgttaccaaaacagatatatagaccaatggaacagaatagaggcctcagaaataacaccacacatctacaaccatctgatctttgacaaacctgac

SEQ ID NO: 71974 - DNA, 201 bp, Homo sapiens
accaccaaggtctcaccctgccttctttgggtctccctcagtttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctg

SEQ ID NO: 71975 - DNA, 201 bp, Homo sapiens
gggaatatcacacaccagggcctgttgcggggtgggggattgggggagggatagcatcaggagaaatacctaatgtaaatgacaagttattgggtgcagcmaaccaacatggcatatgtatagctatgtaacaaacctgcacgttgtgcacatgtaccctagaacttaaagtaaaatttaaaaaaaagcctcataatcctt

SEQ ID NO: 71976 - DNA, 201 bp, Homo sapiens
tgttgcggggtgggggattgggggagggatagcatcaggagaaatacctaatgtaaatgacaagttattgggtgcagcaaaccaacatggcatatgtatasctatgtaacaaacctgcacgttgtgcacatgtaccctagaacttaaagtaaaatttaaaaaaaagcctcataatcctttttattttttatagtcagtagt

SEQ ID NO: 71977 - DNA, 201 bp, Homo sapiens
ttctgagttagaatcttaggatgcatttgcaagagtgttcatactaattacctccacacagagatcaggcatctgaggcacagggagggaaacagaggcarggccaaaactcaccgcacacttcagtggatcctaaaccaggccattgtccctcctgctgactacacacaggctctgcctaccagctgacatgctacttca

SEQ ID NO: 71978 - DNA, 201 bp, Homo sapiens
ttatgataaaactaaaatgaaagcgtaaaaggccaagaaaactaaggcattcctgaagatgataaacagtgtgtgtgagttggagggtgggataccattasctatgacaggtctgaggagtggtagaaatggcatttcaaattagcgtggaaaagatgggttattaaaattatgctggggcaagtagttacccacatggaa

SEQ ID NO: 71979 - DNA, 201 bp, Homo sapiens
aattaaagaaactaaaaataatacaaggttattgaaaacaataatgtaaaaggatacacatggtcacagtttaaaactattcattctatgactcataaacrcagtaattctttccaataaccaagtgctcagatgggatgcaagtttgctggggctcttaaggagctattaaaaagaaatgtttaatctgtaggtcatgtc

SEQ ID NO: 71980 - DNA, 201 bp, Homo sapiens
ttctaagcattacactaggctgcccgttattactgagtacgtattctgtggcagacattgtcaggctctgaagaacttcttctgaggtggaagactgaaakaatatgaacaatgtcaatgcattgtgataaatgccatgttagaggtctgcagagtacaaaagtaacaaggaaagagggtaactaattctgctctggggca

SEQ ID NO: 71981 - DNA, 201 bp, Homo sapiens
ctttctcagcccacctggggagatttaagaaaccctcaccaatgctcacatatctctaatcagtgattcaggggatgtatcaattctctaaattttttccrgatttttcctagaatttatttgttcaccatttatgcccagattctagaaaagtgttttgcatacatttggtggttagtaaatttttttttgaatgattta

SEQ ID NO: 71982 - DNA, 201 bp, Homo sapiens
agaagctcatcgttggattccctacctatggacacaacttcatcctgagcaacccctccaacactggaattggtgcccccacctctggtgctggtcctgckgggccctatgccaaggagtctgggatctgggcttactacgaggtatgtagattggactgaaaagtgctctgtgaattccgtgcactgtgccttagggcta

SEQ ID NO: 71983 - DNA, 201 bp, Homo sapiens
ccttaaatgtgctgaggtcccagccctgagtcccaggaaagcaagtgattcctgttatcctctttctttaaacaggctcaatggcttaagcacaacaaatytggaggcgccatggtctgggccattgatctggatgacttcactggcactttctgcaaccagggcaagtttcccctaatctccaccctgaagaaggccctc

SEQ ID NO: 71984 - DNA, 201 bp, Homo sapiens
gatctgtaccttcctgaaaaatggagccactcagggatgggatgcccctcaggaagtgccttatgcctatcagggcaatgtgtgggttggctatgacaacrtcaagagcttcgatattaaggtaagatcagtcccttaaatgtgctgaggtcccagccctgagtcccaggaaagcaagtgattcctgttatcctctttctt

SEQ ID NO: 71985 - DNA, 201 bp, Homo sapiens
catttttgataaaggtggggaaaggtagatctactgttgtattcactgaaaagcctttggaatcaccaccaaatctcactgaggctgtaacaatttatggyaaattggaaggcaatcaatccttcagaattagattctacggggtacagacaatcggttcaaagtacatgctttttctttctatccaggtcttgtccttat

SEQ ID NO: 71986 - DNA, 201 bp, Homo sapiens
acgaaggtaccacggtcatttttgataaaggtggggaaaggtagatctactgttgtattcactgaaaagcctttggaatcaccaccaaatctcactgaggytgtaacaatttatggtaaattggaaggcaatcaatccttcagaattagattctacggggtacagacaatcggttcaaagtacatgctttttctttctatc

SEQ ID NO: 71987 - DNA, 201 bp, Homo sapiens
tgtagatttgataggcatttccttaatgattaatggcattaagcatctttttatgtgtttattggccatttcaatatcttctttgaagaaatagatattcwagtcctttgtccattttgaatcaagttgtttggttgtgtgtgtgtgtgtcattgaattttagaagttctctctatattctgaatatctcttatcagataa

SEQ ID NO: 71988 - DNA, 201 bp, Homo sapiens
tgtgtcattgaattttagaagttctctctatattctgaatatctcttatcagataaactctttgcaaatattttctaccattccgtgagttgcacttttaytctgtttgcattgtcttttgatatacaaacatttaaaatattcatgaagtccaatttgtgcattgtattcttttgttgtctgtgatttaggtgtcatatc

SEQ ID NO: 71989 - DNA, 201 bp, Homo sapiens
cttacatttaggccattgatctattttgagttaattttgcctatgatgttagaaaatggcccaaaaacatcaatggggccagatgtggtggctcatgcttrtaactccagtgctttgagaggccaaggtgggcagatttcttgagctcaggagtttgagaccagcttgggcaacatggcaaaaccctgttcctataaaaaa

SEQ ID NO: 71990 - DNA, 201 bp, Homo sapiens
agatccaaacattcttagataaaattatcatttagtcatgacttgaagccattccaaagaacatgtgtgagtagaatattgagagagtagcacctaaagarggaagatttcttaggcactgattgtacaaattacatatgaataattccatgaggaaaaaaaggtttaagaacagctaataacttccaaagtttcttttta

SEQ ID NO: 71991 - DNA, 201 bp, Homo sapiens
caggagtttgagaccagcttgggcaacatggcaaaaccctgttcctataaaaaatacaaaaaaattagccaggcatggtggcacatgactgtggtcccagstaatcaggaggctgaggtgggaggattgctcgagcccaggaagtcaaggatgcagtgagctatgatcatgccactgcactcgagcctgggtgacagagtg

SEQ ID NO: 71992 - DNA, 201 bp, Homo sapiens
tgaccacagtatctaaacagttgcttatcagcccttggaactgccaaaaaagctattaaactggtgttttccatggtgatggtctccaccaccctgttagragccatgacattgttctgtccttgttgggcagagaaggtggtgatgctggtggtgggagggtgtaggttgaaggtcttgggagggtgtttgtagaagaga

SEQ ID NO: 71993 - DNA, 201 bp, Homo sapiens
cacttcagtggatcctaaaccaggccattgtccctcctgctgactacacacaggctctgcctaccagctgacatgctacttcaccaactgggcccagtacyggccaggcctggggcgcttcatgcctgacaacatcgacccctgcctctgtacccacctgatctacgcctttgctgggaggcagaacaacgagatcaccac

SEQ ID NO: 71994 - DNA, 201 bp, Homo sapiens
ttctactttctgtctccatgattttgactattctaagtatctcacataaacagaaaaatcatatattatctgtctttttggactggcttttttcattgagwataatgtctcaagattcatccatgttgtagcaagtcagaatttccttttaaaggctgaataatactttattgtatgtatatataacagttttgttatcca

SEQ ID NO: 71995 - DNA, 201 bp, Homo sapiens
ttctttttatttatttttccataaagacttgctttgatgccagacacaaaatgtccacaatagaaaatctgaccacagtatctaaacagttgcttatcagyccttggaactgccaaaaaagctattaaactggtgttttccatggtgatggtctccaccaccctgttaggagccatgacattgttctgtccttgttgggca

SEQ ID NO: 71996 - DNA, 201 bp, Homo sapiens
taatagctgattaattttctcatcagcaaaattggtgtgatagtaataatcctctttatagggtaaaagaaacaataaagtcaagccctctgatgatagtyattttttttagtcactcagctttactttttattcttttagaatttcattttgtgaccagtccttgtgaaaatgtaaatccaagtgccctgccctttccct

SEQ ID NO: 71997 - DNA, 201 bp, Homo sapiens
ttcaccaactgggcccagtaccggccaggcctggggcgcttcatgcctgacaacatcgacccctgcctctgtacccacctgatctacgcctttgctgggakgcagaacaacgagatcaccaccatcgaatggaatgatgtgactctctaccaagctttcaatggcctgaaaaataagtaggatgagggagatatttaattt

SEQ ID NO: 71998 - DNA, 201 bp, Homo sapiens
ccttggactagcttttctggggaagaaaatcagtaggaactgagatagagttatgcaagttgtctttgttctgctgttttcagaattatttctctatttaytcccctattatcctactgagttgatgatgtaccataaacatgttagaaattaaattattcaaagaggttgattcagtaagttgtttagagacaagtcata

SEQ ID NO: 71999 - DNA, 201 bp, Homo sapiens
tccctcctgctgactacacacaggctctgcctaccagctgacatgctacttcaccaactgggcccagtaccggccaggcctggggcgcttcatgcctgacracatcgacccctgcctctgtacccacctgatctacgcctttgctgggaggcagaacaacgagatcaccaccatcgaatggaatgatgtgactctctacca

SEQ ID NO: 72000 - DNA, 201 bp, Homo sapiens
ctccatagtctggtgagtgtaaatatatatatatcttttcccttctccctttcccattgcaatttgattgttatatcaatttgcttattatatcaagttgyttattatatcgtttgcttattacatctgcattgccatttatgtgagataaaggttgtttacccttaaaggtattgtgtgtgtgtcttttctcctcccctc

SEQ ID NO: 72001 - DNA, 201 bp, Homo sapiens
agaaccttttccaaatgaaacctcaagctcaatttataaaacaatcagagtagaagaattgctttgtagaagtcagggaaaggtatctggagtctcacccmatagttcctagctcttctctcctcatataaggcctcctgaaagtcattccaaaaaaccactaaaggccagaagatactgaattctctgatttagcagatg

SEQ ID NO: 72002 - DNA, 201 bp, Homo sapiens
cctaccagctgacatgctacttcaccaactgggcccagtaccggccaggcctggggcgcttcatgcctgacaacatcgacccctgcctctgtacccacctsatctacgcctttgctgggaggcagaacaacgagatcaccaccatcgaatggaatgatgtgactctctaccaagctttcaatggcctgaaaaataagtagg

SEQ ID NO: 72003 - DNA, 201 bp, Homo sapiens
aaataaaaacctgtaactagaaattgagcaaaaccccaactggagacatgaaagaagaaaaatttgaaacatgtttttctttaatgggagtaacatttaawagatttgaatctcttgacttttgaaagatctgtaccttcctgaaaaatggagccactcagggatgggatgcccctcaggaagtgccttatgcctatcagg

SEQ ID NO: 72004 - DNA, 201 bp, Homo sapiens
taaacacagctgcttaaagtgtttaaatagcattcatttacataatccaaatgaatagcatttaacaatgcataatatcccttcacacaacagactacctyttaaatgtaatttatattagcacacaggtaataaaataaatatacctctcatattactgtgggttcccaaaatcatttgacaagcaacttgatcctcttt

SEQ ID NO: 72005 - DNA, 201 bp, Homo sapiens
acagatacaggtggattaatctctagtattgaatgggaacctatcatctagctgttaccaccttccttattggccaatacaccattttatttgatgggatktcagtcctataaagtagttcatctactttatgaaacaaatttctatactgctggatgtagggtatcactgcaactagagcttcaaagtatagagatacaa

SEQ ID NO: 72006 - DNA, 201 bp, Homo sapiens
gaacatactctggcgcaccctaatagtgcaattataagaactaaacccagtactccaaatgagattacagtcgcacagatacaggtggattaatctctagkattgaatgggaacctatcatctagctgttaccaccttccttattggccaatacaccattttatttgatgggatgtcagtcctataaagtagttcatctac

SEQ ID NO: 72007 - DNA, 201 bp, Homo sapiens
gcaaccagggcaagtttcccctaatctccaccctgaagaaggccctcggcctgcagagtgcaagtaagtgactgagggggaatgcccaggtgtataaataycccttctccaactcaaaaagcaaccctgatgtcttcccacctcccccttgcccagggatcctctttccacttcacctcaccgctcttgcccagatgagag

SEQ ID NO: 72008 - DNA, 201 bp, Homo sapiens
ctggagttcaggacaaaaaagcttgatatacttggtttttagacttactgtctcccaagacagattgtttgctattccattctatgtaacagatcgtcacycagcctctgaatagtttcaatgttaagtaataggtgaaaagtcaatttacttacttgttgaattgccctaatgatcataaaggaatatctctttcttggc

SEQ ID NO: 72009 - DNA, 201 bp, Homo sapiens
gtaaatacaggaagaagtgtagatttgaaagaagaagaattgaccttgaacttgatgagtatgaggtatctgtagagcatcctaacagagtgcccagtagscatcagataaatatcaatctggagttcaggacaaaaaagcttgatatacttggtttttagacttactgtctcccaagacagattgtttgctattccattc

SEQ ID NO: 72010 - DNA, 201 bp, Homo sapiens
tattaactaagatggtaaatacaggaagaagtgtagatttgaaagaagaagaattgaccttgaacttgatgagtatgaggtatctgtagagcatcctaacrgagtgcccagtaggcatcagataaatatcaatctggagttcaggacaaaaaagcttgatatacttggtttttagacttactgtctcccaagacagattgt

SEQ ID NO: 72011 - DNA, 201 bp, Homo sapiens
cagcccattgagccaataactgctgctcccagtggcagcgggaacgggagcgggagtagcagctctggaggcagctcgggaggcagtggattctgtgctgkcagagccaacggcctctaccccgtggcaaataacagaaatgccttctggcactgcgtgaatggagtcacgtaccagcagaactgccaggccgggcttgtc

SEQ ID NO: 72012 - DNA, 201 bp, Homo sapiens
aataatatgaacaatgtcaatgcattgtgataaatgccatgttagaggtctgcagagtacaaaagtaacaaggaaagagggtaactaattctgctctgggkcaggatcagaaagtgtttcctagagaaagtgatgcttgggctcagtcttgaaagaaactggtgttaaccaattaagtgaggatgggaatggcacaaatga

SEQ ID NO: 72013 - DNA, 201 bp, Homo sapiens
ctggaggcgccatggtctgggccattgatctggatgacttcactggcactttctgcaaccagggcaagtttcccctaatctccaccctgaagaaggccctyggcctgcagagtgcaagtaagtgactgagggggaatgcccaggtgtataaataccccttctccaactcaaaaagcaaccctgatgtcttcccacctcccc

SEQ ID NO: 72014 - DNA, 201 bp, Homo sapiens
aaactctcctggccattggaggctggaacttcgggactgccccgtaagtcttctatggagagcatgttgttcgtttgctatggaaaacaagttagccccaygtgatcactgtccctttagacttcacaatctaagacagggtattgaggatgtacataaacaaatatatgaattaaatatattgctacaccagaacctcat

SEQ ID NO: 72015 - DNA, 201 bp, Homo sapiens
atggagggagtcctgacttttgaagtttatctgtttctatcctttgttttacaggaacagccagctgaaaactctcctggccattggaggctggaacttcrggactgccccgtaagtcttctatggagagcatgttgttcgtttgctatggaaaacaagttagccccatgtgatcactgtccctttagacttcacaatcta

SEQ ID NO: 72016 - DNA, 201 bp, Homo sapiens; identical to SEQ ID NO: 25129

SEQ ID NO: 72017 - DNA, 201 bp, Homo sapiens
atctaccaagcaaatggaaagcaaaaaaaaaaaaaaaaaaaaacaagcaggggttgtaatcctagtctctgatgaaacagactttaaaccagcaaaaatcraaagagacaaagaaggccattacataatggtaaagggatcaattcaacaggaagagctaactatcctaaatatatatgcacccaatacagaagcactcag

SEQ ID NO: 72018 - DNA, 201 bp, Homo sapiens
cagaaaactaaacactgcatgttctcactcataagatggagttggaacaatgagaacacatggacaccgggaagggaacaagaaacactggagccagctgrggggttgggggcaagggggggagagcattaggacaaatacctaatgcatgtggggattaaaacctagatgacgggttgataggtgcagcaaaccatcatg

SEQ ID NO: 72019 - DNA, 201 bp, Homo sapiens
gagggctaatattcaacattcttaaataaaagaattttcaacccagaatttcatatccagtcaaactaagcttcataagtgaaggagaaataaaatccttyacagacaagcaaatgctgagagattttgtcaccaccaggcctgccttacaagagctcctgaaggaagcactaaacatagaaaggaacaactggtaccagc

SEQ ID NO: 72020 - DNA, 201 bp, Homo sapiens
tggttattgcagcactatttacaatagcaaagacatggaaccaactcaaatgcccatcaatgatagactggataaagaaaatgtggtacatatacatcacrgaatactatgcagccataaacaggaatgagatcatgtctttgcagggacatggatgaagctggaagctatcatcctcagcaaactaacacagaaacagaa

SEQ ID NO: 72021 - DNA, 201 bp, Homo sapiens
attgtgtgtgtgtcttttctcctcccctcacacatctctcacacagatcattttatacccaaagggatataaatcattctactataaagacacatgcacaygtatggttattgcagcactatttacaatagcaaagacatggaaccaactcaaatgcccatcaatgatagactggataaagaaaatgtggtacatatacat

SEQ ID NO: 72022 - DNA, 201 bp, Homo sapiens
aatttttataaaggaagttttcagtaggggaggaaaattgttctacaaaaggcaaaacaaaaatatctgaccagatccaatactaaagcaatgtattttaratggagggagtcctgacttttgaagtttatctgtttctatcctttgttttacaggaacagccagctgaaaactctcctggccattggaggctggaacttc

SEQ ID NO: 72023 - DNA, 201 bp, Homo sapiens
ctcccgggttccagcaattctcctgccttagcctcccaagtagctgagattacaggcacctgccaccacacccagctaatttttgtatttttagtagagayggggtttcaccatgttgacccagctggtctcaaactcctgacctcaggtgatccacccgccttggcctcccaaagtgctgggattacaggtgtgagccac

SEQ ID NO: 72024 - DNA, 201 bp, Homo sapiens
tcagtgcaaatctgcccttgaacctttctagtaagttttccatttcagttatattactttttagctccagaatttattttctgtttttgtccaaatttttwaaaatcttattattgaaatttacattttgttcatacatcattttcttcattctctacatcctttttttagagcatattcaagacagttgttctaaagtct

SEQ ID NO: 72025 - DNA, 201 bp, Homo sapiens
agtttctgatgagagatctgctgataattttattgaagatcccttgtatgtggccagttgcttctcttttgatgatttcaagactctctttgcctttgtcytttaaaatttgattatattgtgtcttgcgtggatttctttgagttcatcttacttggagttcgctgagttcttggatgtctatatacatgtctttcatca

SEQ ID NO: 72026 - DNA, 201 bp, Homo sapiens
ttcatcctataggactcccttgagtatttcctgcaggacaggtctattggtaacaaactacatcagcttttgtttatctagaaatgtctcatgttatcccytgttttgaaggatagttttgccagaaaaaagatttttggttgacactttttttcttttagaactttgaatctatctgccaactgccttctggcctctaaa

SEQ ID NO: 72027 - DNA, 201 bp, Homo sapiens
aaaggcaaaacaaaaatatctgaccagatccaatactaaagcaatgtattttaaatggagggagtcctgacttttgaagtttatctgtttctatcctttgytttacaggaacagccagctgaaaactctcctggccattggaggctggaacttcgggactgccccgtaagtcttctatggagagcatgttgttcgtttgct

SEQ ID NO: 72028 - DNA, 201 bp, Homo sapiens
tggatcatgtgttttaattgattctgccaatctcagtattttgattgaagcattaatatatttatatttagagtaattactgataaagagggaattatttmtgtcattttaattatttgtttcctatatgccttttagcttttttgtcactcatttctggcattattgtctttctttgtggttagttgattgttcgtagtg

SEQ ID NO: 72029 - DNA, 201 bp, Homo sapiens
atgacaggaacaacacaaagaatttttataaaggaagttttcagtaggggaggaaaattgttctacaaaaggcaaaacaaaaatatctgaccagatccaayactaaagcaatgtattttaaatggagggagtcctgacttttgaagtttatctgtttctatcctttgttttacaggaacagccagctgaaaactctcctgg

SEQ ID NO: 72030 - DNA, 201 bp, Homo sapiens
gaaataggaacaaactattcctagaataaaggctacttcaaacctatcctaataaagcttaaaaacaaggctgggccctcggagcccagcgccgccaccaygtcctctggggctagcgcgagcgccctgcagtgcctggtggagcagctcaagttggaggctggcgtggagaggatcaatgtctctcaggcagccgcagag

SEQ ID NO: 72031 - DNA, 201 bp, Homo sapiens
ccactccttggaaataggaacaaactattcctagaataaaggctacttcaaacctatcctaataaagcttaaaaacaaggctgggccctcggagcccagcrccgccaccatgtcctctggggctagcgcgagcgccctgcagtgcctggtggagcagctcaagttggaggctggcgtggagaggatcaatgtctctcaggc

SEQ ID NO: 72032 - DNA, 201 bp, Homo sapiens
ggctctgggacacctaaaaaacactcttttataccaaaagccattgaattgtgtaaacttgaaatggataagttgtacgctttgtaaattatatctcaatraagctcttgtaaaaaccttgcttttgactcctttgtgtacatcttttactacattgtgcttcctggaataaagatgtgatggctagtcctctagctgcca

SEQ ID NO: 72033 - DNA, 201 bp, Homo sapiens
ctaagtcatgaagtagacaccaaaatctctggagggttcaaattgtgaactatgcttgaaatcatgggtgggctagacactggggaggcaggatttcctcytggagacaagttctcacatggtttgacttcatctattgccaataatatcctttctctccttcttccatagtaatagaatttttagcatcactaaaaggct

SEQ ID NO: 72034 - DNA, 201 bp, Homo sapiens
tgatggctagtcctctagctgccatcttggactatgaggatgagggtcacaccccaagatggcagagcagtgaactggaaggagctggggcctggaggacytcactgaccaaagctgtctagccggtttttgggttacatatatctttggaatattttgcgaaatgaaaacaaatttctgttttctttgaaccactgctaa

SEQ ID NO: 72035 - DNA, 201 bp, Homo sapiens
gtgtaaacttgaaatggataagttgtacgctttgtaaattatatctcaataaagctcttgtaaaaaccttgcttttgactcctttgtgtacatcttttacwacattgtgcttcctggaataaagatgtgatggctagtcctctagctgccatcttggactatgaggatgagggtcacaccccaagatggcagagcagtgaa

SEQ ID NO: 72036 - DNA, 201 bp, Homo sapiens
aatggatgtaactgggagaatttcacagaggctctgggacacctaaaaaacactcttttataccaaaagccattgaattgtgtaaacttgaaatggataakttgtacgctttgtaaattatatctcaataaagctcttgtaaaaaccttgcttttgactcctttgtgtacatcttttactacattgtgcttcctggaataa

SEQ ID NO: 72037 - DNA, 201 bp, Homo sapiens
tctggcttcctatgtccccctgtgtgtaacatgcagattcaggaaggaggcttcttcctgcacggactgcaatcccttgtgggccccaatgggctgtgtgrcctctttgagccacattctatctgaaacatggagataattatattttctcacgctgcttactcatggaatcgagataatcaatgagctaatgcgtgggga

SEQ ID NO: 72038 - DNA, 201 bp, Homo sapiens
gttttcaagccagaaaaaggttaattcctttctttcagcttctggtaatcaaagagagagtaaggaaagacagagtaagttatttgtgtgagaaaactccrgaaatttctaaatgcactctgaaatcttctctgcttcctcttgattccaaattaatcctccagactatgaaccttctccccacaatcagatctgagagcc

SEQ ID NO: 72039 - DNA, 201 bp, Homo sapiens
gagaatccaaagtaagcaaaaaggaaacatgagagagaatgttggatggggtgcgatgtttttgggttggtccagaaaagcctctgtggggagagaacacrggagttggacggcactaccggaaggaatggaatggctctgggaagatgagaatgcagcgccttcccagtagggggcgctacctgtgaaagagctgagctg

SEQ ID NO: 72040 - DNA, 201 bp, Homo sapiens
atttactaagcatgcaagtaagttaaatagaacttcagaactcaggcagagtagacattccattaactaatctgtgtactctttgcaaatcttcacattcyctgttccaacatctacattgcatttaaaaccaacgtttttgtcttgtcttctaagaagcctctgtaaactctcctcctggaattttctcatcttttctga

SEQ ID NO: 72041 - DNA, 201 bp, Homo sapiens
gttcaacatatattattattactgaaagcctgtcatggttaactctatggaatgtggtgtaaaaataggatttgaaccctaattcatgtgatttagggcarcctattatttaaatgacttataaaattgataaaataataaatattctactggtttattgtgagagtccagtatactactatttgtaaagtacttagaaga

SEQ ID NO: 72042 - DNA, 201 bp, Homo sapiens
tgtaactggtttcttcaccaattaataagagtaattaatggagatcctggcacatagcagatacctaattaatgtgtgatgaataaacaaatgaagtataygcatgcaataaagagtgctttcttaattattatttgggcgctacaaattggaattttccaatgcttactcatttctgtgagttacaaaattatgatcagg

SEQ ID NO: 72043 - DNA, 201 bp, Homo sapiens
aactcacattgtatttcaaatagcactctgacaagtatttacttagcacactcttgcccagacacagcagaaagtccaaataaatgaatgagtaccctagygtaaaaccactggaaaaatcaaactgtttttctgaatatagaaaagccaaatttaactttaaatcatcaagattttttctccagaataatcggaatctat

SEQ ID NO: 72044 - DNA, 201 bp, Homo sapiens
aaaaactatgctaccctaaagagaaacaaggtgccctaggggcatgtacctctgacattgtctcccctcagagaatcagaggattgcctgaaaaaaaaaaatgccatctggtcttagacttggagaatgaacagaaagtataggagaataggaagcaaggagaaggtgggagactggactagacattaaatgaagagcaga

SEQ ID NO: 72045 - DNA, 201 bp, Homo sapiens
cactagcttaattatctccaaggtttacatctcacctcacaacatttaactgaaactcctaaaatgcaggaattgcttgcttttaaattttttttttttttgtctattttatgatactaaaaagcatttggccagggaggagtaagtcaaattcatagccatggctgcctctttggccgggcaggctgactttactggtcg

SEQ ID NO: 72046 - DNA, 201 bp, Homo sapiens
atcatctgaagccttcttctctcagcttgtcaaagtcattctccatccagctttgttccgttgctggcgaggaactgcgttcctttggaggaggagagtcrctctgctttttagagtttccagtttttctgctctgttttttccccatctttgtggttttttctacttttggtctttgatgatggtgatgtacagatgggt

SEQ ID NO: 72047 - DNA, 201 bp, Homo sapiens
tgatcatctgaagccttcttctctcagcttgtcaaagtcattctccatccagctttgttccgttgctggcgaggaactgcgttcctttggaggaggagagkcgctctgctttttagagtttccagtttttctgctctgttttttccccatctttgtggttttttctacttttggtctttgatgatggtgatgtacagatgg

SEQ ID NO: 72048 - DNA, 201 bp, Homo sapiens
tgtaaaacgtaaggttgcatctaacacgataaatatgttaaattttccagaatatattcaactccaaggcccatgcagtgttatctgtgatctacctacastttcatttctaaactctcattttcagtaaacatgtcatcatcctgttagagaccaccttgtcttttatgggacgggatcaaatttccaattagccaaaaa

SEQ ID NO: 72049 - DNA, 201 bp, Homo sapiens
gggaagttctcctggataatatcctgcagtgttttccaacttggttccattctccccgtcactttcaggtacaccaatcagacgtagatttggtcttttcmcatagtcccatatttcttggaggctttgctcatttctttttattcttttttctctaaacttcccttcttgcttcatttcattcacttcatcttccatcgc

SEQ ID NO: 72050 - DNA, 201 bp, Homo sapiens
ttataacatatatgaataatctgcagtctttttttttctttaatttatttatttattattattatactttaagttttagggtacatgtgcacaatgtgcargttagttacatatgtatacatgtgacatgctggtgggctgcacccactaactcgtcatctagcattaggtatatctcccaatgctatccctcccccctcc

SEQ ID NO: 72051 - DNA, 201 bp, Homo sapiens
gccaggatggtctcgatctcctgacctcgtgatctgcccgccttggcctcccaaagtgctggaattacaggcgtgagccaccgcacccggcccaggaatgyactcttaaaacaaatattaaatccaaactttggggccaagagcttttcctgatactgtggataagtctgtaaatgataccagaagtttcaaattgcaagg

SEQ ID NO: 72052 - DNA, 201 bp, Homo sapiens
ccacttgactgtaagcttgaacatgtaagaacatttcctcaaaatggtaccctcacaactagcagagtatttttcacaaacttttgctcaccaaattttcyagaatgaatatgccttccttctgcttaaaacttccagtgtgtgcttattgtctattaaataaaatcaaacttacttaccttttattaaatattcttcaag

SEQ ID NO: 72053 - DNA, 201 bp, Homo sapiens
aactgcctcagtctaaaggacaaacccaaggtcatcattgtccaggcctgcagaggtggtgagtgctgaggctgaacatctaacagttttgaaggtgtatrcagaggattgtgatgtttggtttatatttaggggaaacaatgttagaccccatccagtgcaaataaagtacattgaattatgaagaaactctacctaagg

SEQ ID NO: 72054 - DNA, 201 bp, Homo sapiens
tattctggaacttaaagtaacataaaaaaaaaagaaagttgatgtctctacagaaaaacatggggaactctgggtcagagactctccagcatccttggcastcatctcttcacagtcatctgagaacctggaggcagattctgtttgcaagatccacgaggagaaggacttcattgctttctgttcttcaacaccacgtat

SEQ ID NO: 72055 - DNA, 201 bp, Homo sapiens
agagtatttttcacaaacttttgctcaccaaattttccagaatgaatatgccttccttctgcttaaaacttccagtgtgtgcttattgtctattaaataamatcaaacttacttaccttttattaaatattcttcaagagttgggccatacctaaaatttattcatttgtttctacattcactcaactagtgattcagtag

SEQ ID NO: 72056 - DNA, 201 bp, Homo sapiens
atacaatacaaggaaccccattcgccacacaccatgtaaacatagatgatggatgctgtttttttaataaatccatttaacattttgaatagaagttttayggatcccagtactggctgtctttccaaacgatcaacttcaagccctcttctacatatatcccacttgatcctacaaagagcaatgttattaagtgtccag

SEQ ID NO: 72057 - DNA, 201 bp, Homo sapiens
gaatgaatatgccttccttctgcttaaaacttccagtgtgtgcttattgtctattaaataaaatcaaacttacttaccttttattaaatattcttcaagakttgggccatacctaaaatttattcatttgtttctacattcactcaactagtgattcagtagataattattagacttcccttgagtgccagaagtagtgca

SEQ ID NO: 72058 - DNA, 201 bp, Homo sapiens
caccatgtaaacatagatgatggatgctgtttttttaataaatccatttaacattttgaatagaagttttatggatcccagtactggctgtctttccaaaygatcaacttcaagccctcttctacatatatcccacttgatcctacaaagagcaatgttattaagtgtccagataaaaatgtgaatgagctttaaaaaagg

SEQ ID NO: 72059 - DNA, 201 bp, Homo sapiens
ggaatacctgggcaaagatgttcttcatggtgtttttaattatttggcaaaacacgatgttctgacattgaaggaagaggaaaagaaaaaatattatgatrccaaaattgaagacaaggccctgatcttggtagactctttgcgaaagaatcgcgtggctcatcaaatgtttacccaaacacttctcaatatggaccaaaa

SEQ ID NO: 72060 - DNA, 201 bp, Homo sapiens
tcatcacccaaatctatgctgtaaacatctctcctccaaaagattcctccagctctctatttattattatcatcattctgcaagggtgtgataaggataayttacataagatctactctctgcaaatttttaagtatataagacagtattatttactattggcaccatattatacagtatttttctatattttaatcttct

SEQ ID NO: 72061 - DNA, 201 bp, Homo sapiens
attaaatgaagagcagaatattttaattgtaatgagcaaggtggggacagtatcagaagatgaggctgaatgagaaggcctaggttagaataagctgagasgtttcatggtcaaatctagatataggaacactctttattgtgaagaatagaatagaaaggacaaacagaaggtttataaggttcttggtgtaattcagaa

SEQ ID NO: 72062 - DNA, 201 bp, Homo sapiens
gacagtattatttactattggcaccatattatacagtatttttctatattttaatcttctataactgaaactttggatgtgttcatctattttgtttattwtatggtgaaagacatcatggtgcaatctgtaaacaatcttggagcccgacggtagttttttgttgcttcctcactgaacctaaaagtttattcatccttc

SEQ ID NO: 72063 - DNA, 201 bp, Homo sapiens
tgaatgagaaggcctaggttagaataagctgagaggtttcatggtcaaatctagatataggaacactctttattgtgaagaatagaatagaaaggacaaamagaaggtttataaggttcttggtgtaattcagaaagaaagggtgttggcctgaatagaagtaatgaacaattaaaattaagagtagtggtcagattctga

SEQ ID NO: 72064 - DNA, 201 bp, Homo sapiens
ggaataagacatacagaaggcagaagaagtttaatatcaccaggttttgctgccttcccgcacttggaagttaggtattagtttttactatatggaggagsaaatgaaggatggaaatagaagaaaattagcagttcaattttaaaagttcaattgaatgaggttgtgggagtattttaagtgacgtctcatttttggacg

SEQ ID NO: 72065 - DNA, 201 bp, Homo sapiens
ttatgtgtttaacttttgtgagtctacacatcagtgagatcatatagtatttgttttttggtgcccagcttggcttattttatttaatgtaatgttatccwtgttaatcaatgttgtcacaaatgacaagatttctttcttttttctaaagctgaatactgttgcattatgatactttctccatccattcatccatctaca

SEQ ID NO: 72066 - DNA, 201 bp, Homo sapiens
atacttaggttgattttatatcttgcctattgtgaataatgctgcaatcacaatggaagtgtatatgtcttttcaacacactgacttaatgtttaaaatayatactaaatatttgggctgctacatcatttttaacatttttaattcattttaatttttaactttttgaggagtttcctattgtttttcattatgactgta

SEQ ID NO: 72067 - DNA, 201 bp, Homo sapiens
aggaataatttacagtctagacaagagaatggactgtcctgggtgcacacacttcaggtaggtcatcatgagtttgagcaagagagagaaatctgaatacmatggatgaccaggaatttagcattaggcccaatgctgcagaaaggaaaaagacaagctataaaaaacaaacttaagtggcaatgaattgttaaacacagc

SEQ ID NO: 72068 - DNA, 201 bp, Homo sapiens
tataagtggcatttattgtgttgtaaacctctttaggttaattgcttttcacatgtctccacatattcattcagtcaaaactatattcatttactaagcaygcaagtaagttaaatagaacttcagaactcaggcagagtagacattccattaactaatctgtgtactctttgcaaatcttcacattccctgttccaacat

SEQ ID NO: 72069 - DNA, 201 bp, Homo sapiens
aaaattttgttcaatgtcctgacatgttttctttagaaaatgtattttgtgtgaaagctatccttatatttagataaactagataatgatctttatagagwtaacagaagagaggagatatctggcttttccacatacaacctgcttaaatcatatctcttgtattgaaataagtgatttattactttgatatatatatgt

SEQ ID NO: 72070 - DNA, 201 bp, Homo sapiens
tccaataaaaaagagagaggaccgcagacgcctggctctcatcatatgcaatacaaagtttgatcacctgcctgcaaggaatggggctcactatgacatcstggggatgaaaaggctgcttcaaggcctgggctacactgtggttgacgaaaagaatctcacagccagggtaagaacccctaagccatctcacactcatcc

SEQ ID NO: 72071 - DNA, 201 bp, Homo sapiens
gtgtcattaagcttttccacgtttttgtgtagtagtttcaaagtttcagttattaggcttatgtttttaatccattttgagttgatttttgtatatggtgrcagataagggcccgttttcattcttctgctcttggatatttaattttcccaacatcatttatcgaagaaagtgtccttagcctattgtctgttcttgaaa

SEQ ID NO: 72072 - DNA, 201 bp, Homo sapiens
tcattgatcagtccatgcataagatttcagaggtcagcatggtggtgtgggcatgaaagttgttcagtgttcaggccttaaagcaagattctgggatttarttctccttaaattgaagaatcagcgttggtgggggttgaaagtactaaatcttccatatccagttctcatgagcatatcccaaaggatatttaattgatt

SEQ ID NO: 72073 - DNA, 201 bp, Homo sapiens
agtagtatttacagtctagacaagagcatggactgtcctgggagtgtccatttcaggtaaattatcatcatcatgagctgtgagcaagagaaagagaaatrtgaaagcagcaggtgaccaggaaattagcattattcccaatgccacagaaggaagaagaaaagctataaaaacaaatttaagaggaaatgaattgctaag

SEQ ID NO: 72074 - DNA, 201 bp, Homo sapiens
ctcctggtaaaaatctgaattataccaaggagtaatacattaactcagtattatattaatctaccataatatttgttaaatattttcaattctaaattttrgtttgagaaaaggcgctgaagaattaggtatctagatgcatttatccacttaatgattaagttggatgtttacttatgtattcagcaagcagattaagca

SEQ ID NO: 72075 - DNA, 201 bp, Homo sapiens
cttgcccaacttgggacattccttattccccatccttcctactttattttctccacagttcttacctcctcccattaagcatatattaatagtttatttaygtgtctgttttttacctgtatttactcactaatatgcaaacttcaggatggcggggatttgctcagcacctcaatatgcctgacatatagcagacattca

SEQ ID NO: 72076 - DNA, 201 bp, Homo sapiens
tcaccaaggaagctaaatacagagaaaaggaaagatcctgcagtctagtaggaataatttacagtctagacaagagaatggactgtcctgggtgcacacayttcaggtaggtcatcatgagtttgagcaagagagagaaatctgaatacaatggatgaccaggaatttagcattaggcccaatgctgcagaaaggaaaaag

SEQ ID NO: 72077 - DNA, 201 bp, Homo sapiens
ggctaaaaggctgagtccttgggttcagattgtgcatggaaataattaatagtagaggcttgtagtaagacatattcaaacctaaatctagattctgttaytaataatctgtgtggcttcctgcatgtatcttaacctctcttgctccctaatcatcagtcttaccatctatgaaatggggacaatttcagtactttctca

SEQ ID NO: 72078 - DNA, 201 bp, Homo sapiens
ctaaatacagcaaagaggcaagattgtatagtctagtagtatttacagtctagacaagagcatggactgtcctgggagtgtccatttcaggtaaattatcwtcatcatgagctgtgagcaagagaaagagaaatatgaaagcagcaggtgaccaggaaattagcattattcccaatgccacagaaggaagaagaaaagcta

SEQ ID NO: 72079 - DNA, 201 bp, Homo sapiens
aggccaactgtcttatacacagaagctaaaaaagcctatgagttggagtcctgggctacttaagcagctcgtattccagcaggtcatattgcgtctttggyttcattctcctcactggaaaaaggaagaaactggaatagatcagtgctttctaaaccttataacatatatgaataatctgcagtctttttttttctttaa

SEQ ID NO: 72080 - DNA, 201 bp, Homo sapiens
ccctatgcaacaatgagctgagagaatggtgtgtgctctctatatattttgcatgatcttatgtgtgctgtgagaatagattccttccccctcccacacayacattttaaaaaactgtacttttattataagtgttacactttacagtcaaaggcataccaaatattaaagcaatacaatacaaggaaccccattcgccac

SEQ ID NO: 72081 - DNA, 201 bp, Homo sapiens
agaacactgaaaaataacaaggtgggcaattgtgatagccatgctaagtgaggcacatcagtgtataaaaagttgatgtctcttgatccaacccaaatgtycatcaatgatagatagactggacaaagaaaatgtggtacacatatcccatggaatactgtgtagccctaaaaggaatgagatcatgtcctttgcagggac

SEQ ID NO: 72082 - DNA, 201 bp, Homo sapiens
ctgggctcttgagagagaggaaggcagtgtcttctgatagaggttagggaaggtggcagctgcatgaggtcttaaaaaagcaaaattgtgaggcatatggrggttgaaaagagactcgggtaatcaaagttgcttcatctccatctcctgcagatctatccaataaaaaagagagaggaccgcagacgcctggctctcatc

SEQ ID NO: 72083 - DNA, 201 bp, Homo sapiens
ggaattctcacaacacatttccttaagctggaaattaggtacagctataacccctaaatataaagagtctttttcctaggatttctctctctctctctctyaaagttcttaggtgataaattgggtcacagaggcagaaaccataatttatattttgtgatatcccacagctcttctgcaaatcgaggctggaccacctga

SEQ ID NO: 72084 - DNA, 201 bp, Homo sapiens
atttttaccttttgtaaatgtgatattagaaaatttaatattgcatatggaactcacattgtatttcaaatagcactctgacaagtatttacttagcacastcttgcccagacacagcagaaagtccaaataaatgaatgagtaccctagcgtaaaaccactggaaaaatcaaactgtttttctgaatatagaaaagccaa

SEQ ID NO: 72085 - DNA, 201 bp, Homo sapiens
atgaaatatttaaaaacaatataaattttatacagaacaatattactttactcatgattcctatgtcttggttgggtcacgtaaccaaacataaaagtatrcttgtccatttctttcatgaaaagaaatcttgttattagatcttactaaattcttctttgaatttgtatacataaattcctttttcttttccagaaggag

SEQ ID NO: 72086 - DNA, 201 bp, Homo sapiens
tcaaaggtatccttcagagtggattggataacttcgtgataaaccacatgctaaagaacaacgtggctggacaaacatctatccagaccctagtacctaayacggatcaaaagtcgaccagtgtaaaaagtaagactggatattttacaatggatatttccaattttttagaatctgttcaattataagtcccatgcagtg

SEQ ID NO: 72087 - DNA, 201 bp, Homo sapiens
atttacagtctagacaagagcatggactgtcctgggagtgtccatttcaggtaaattatcatcatcatgagctgtgagcaagagaaagagaaatatgaaarcagcaggtgaccaggaaattagcattattcccaatgccacagaaggaagaagaaaagctataaaaacaaatttaagaggaaatgaattgctaagcacagt

SEQ ID NO: 72088 - DNA, 201 bp, Homo sapiens
agagttgaaggagtctttatatttctgatagaagacagtggcaaaaaaaaaaggcgtaagaattttgaagctatgttcaaaggtatccttcagagtggatkggataacttcgtgataaaccacatgctaaagaacaacgtggctggacaaacatctatccagaccctagtacctaatacggatcaaaagtcgaccagtgta

SEQ ID NO: 72089 - DNA, 201 bp, Homo sapiens
aacctttatgatagatgctttcagcaggcaagggttcatatggcttcaaacaaataccagtgctcattcaatccatgataaaatgtagctttctctttttyatcatttattgatttttgtatcaatttgggatttattacaatttcagataaagccacaaaataaaatgtttataacatggctgagtagtaattgtttata

SEQ ID NO: 72090 - DNA, 201 bp, Homo sapiens
tattacatttcacaaggggatagatcagaattactcagaagcaaacttatccaaaacagatgtattatttcctcacattataaaatatgagttggacagtrttggctgtccagcagtttagagacaagatgttcagagttacgtcagaatctcatacaaatatttgtccctttgaccttggacacagtactattgtgtact

SEQ ID NO: 72091 - DNA, 201 bp, Homo sapiens
aatggtggatgctgagaattaggctggaaatcacaattaaaggtaaaaaactatgctaccctaaagagaaacaaggtgccctaggggcatgtacctctgayattgtctcccctcagagaatcagaggattgcctgaaaaaaaaaaatgccatctggtcttagacttggagaatgaacagaaagtataggagaataggaagc

SEQ ID NO: 72092 - DNA, 201 bp, Homo sapiens
attattagacttcccttgagtgccagaagtagtgcaggcctagtttatggccacctatcctcacagagcataaaatctaatggtggatgctgagaattagrctggaaatcacaattaaaggtaaaaaactatgctaccctaaagagaaacaaggtgccctaggggcatgtacctctgacattgtctcccctcagagaatca

SEQ ID NO: 72093 - DNA, 201 bp, Homo sapiens
ttgtcttctaagaagcctctgtaaactctcctcctggaattttctcatcttttctgagttccttaagcatcttatctgtgttctcttaagaagctcttcawcaactatcatgtaatgtagtttcatgacttaagagttggggctctggattctgatcacttgtacttctattcctgctccggagttactgtatacttcatt

SEQ ID NO: 72094 - DNA, 201 bp, Homo sapiens
tctggagtgcaggataagaagaatcctagctattcatttgttatttaactgtttacacacacacacacacacacacacacacacacacacatatatatatacacactatataccgatgatctgatttagtcaggagataaccacctaagtccctatgtgctgtgggaaattgctttactgatcctgtaccactccactact

SEQ ID NO: 72095 - DNA, 201 bp, Homo sapiens
ggatcaaatttccaattagccaaaaagctgtgtccttgtgtttagactgtgcacagaaatagttaataagggagattttttagtaggagatacctaaaccyaaacttagattctgtcacatgtgaactatgcagcttcatgcaagtttcttgaccttccattctccctagtcatcagtcttaccacctgtgaaatgtgggc

SEQ ID NO: 72096 - DNA, 201 bp, Homo sapiens
ttctggagtgcaggataagaagaatcctagctattcatttgttatttaactgtttacacacacacacacacacacacacacacacacacacatatatatatacacactatataccgatgatctgatttagtcaggagataaccacctaagtccctatgtgctgtgggaaattgctttactgatcctgtaccactccactac

SEQ ID NO: 72097 - DNA, 201 bp, Homo sapiens
tctcatctgagctccagactcatttagctctagcggcatataaaacaattctgctccagtgtttcactggcatcacaaaatgaatacagctaaaattaaaygctttgttttccagaataaacgtgctccacttttaacccttttccgcttcagtaaaaagaagtaacatgcaccaagtttctgctaccagaatgtaactgg

SEQ ID NO: 72098 - DNA, 201 bp, Homo sapiens
attctggagtgcaggataagaagaatcctagctattcatttgttatttaactgtttacacacacacacacacacacacacacacacacacacatatatatatacacactatataccgatgatctgatttagtcaggagataaccacctaagtccctatgtgctgtgggaaattgctttactgatcctgtaccactccacta

SEQ ID NO: 72099 - DNA, 201 bp, Homo sapiens
ccatagactttaaactgaaatcttcagccctgaactactacagcttaccaataatcacatacgatcatgaacataaagcaacataaattgttcaaacctcwctatacaaaataaactccccttctctgtggggaaagtttcccctcaacagaaaccacatgctagtatagttgtccaagattttaggcaaggatgcattct

SEQ ID NO: 72100 - DNA, 201 bp, Homo sapiens
gattctggagtgcaggataagaagaatcctagctattcatttgttatttaactgtttacacacacacacacacacacacacacacacacacacatatatatatacacactatataccgatgatctgatttagtcaggagataaccacctaagtccctatgtgctgtgggaaattgctttactgatcctgtaccactccact

SEQ ID NO: 72101 - DNA, 201 bp, Homo sapiens
aatattactttactcatgattcctatgtcttggttgggtcacgtaaccaaacataaaagtatacttgtccatttctttcatgaaaagaaatcttgttattrgatcttactaaattcttctttgaatttgtatacataaattcctttttcttttccagaaggagggctcaataatctcccagttttttgcacaatatcggtc

SEQ ID NO: 72102 - DNA, 201 bp, Homo sapiens
ttgtttttcattatgactgtactaatttatattttcaccaacagtatacaagagttcctttttctctacatcctttccaacacttgttatcttttttttttataatacccattctaatcattctaacaggtgtgaggcattatctcattgtggttttaatgtccctggtgatcagagatgttgagcattttgtatagacct

SEQ ID NO: 72103 - DNA, 201 bp, Homo sapiens
atatattgtagaatgcctaaagagctaaataacatatgcattacctcatatgctcatctttttttgtgattacagcacttaaaatttacactgtcaaacaattttcaagaattcatcattgactatagtcactatgtggtgcaatagatttcttaaacttacttctccgatctaattgaaatgttgtttcctttgatcaac

SEQ ID NO: 72104 - DNA, 201 bp, Homo sapiens
cccacttgatcctacaaagagcaatgttattaagtgtccagataaaaatgtgaatgagctttaaaaaaggtaagaaatgttagggtggagctaattaggtstaattacaggaaacagtcgtttgtatttcacctctaggtaatcatcctaaagggctttctattttactctttccaagttgtaaattttcaagtcttattt

SEQ ID NO: 72105 - DNA, 201 bp, Homo sapiens
tatatattgtagaatgcctaaagagctaaataacatatgcattacctcatatgctcatctttttttgtgattacagcacttaaaatttacactgtcaaacaattttcaagaattcatcattgactatagtcactatgtggtgcaatagatttcttaaacttacttctccgatctaattgaaatgttgtttcctttgatcaa

SEQ ID NO: 72106 - DNA, 201 bp, Homo sapiens
gtctaatgtctgttgagaagagtgaatctaggttggcctgactcttaaactcaacactctaatgttctgtcaattttctgcaaacaaacatcttcaaatgrtggccctatctcatcacgcccacttcagtcctggctgcacacttcaatactttctaaagcccagctagcccagcttcctgattactttagacaccctaaa

SEQ ID NO: 72107 - DNA, 201 bp, Homo sapiens
atatatattgtagaatgcctaaagagctaaataacatatgcattacctcatatgctcatctttttttgtgattacagcacttaaaatttacactgtcaaacaattttcaagaattcatcattgactatagtcactatgtggtgcaatagatttcttaaacttacttctccgatctaattgaaatgttgtttcctttgatca

SEQ ID NO: 72108 - DNA, 201 bp, Homo sapiens
agcttcctattttgggttataacttattaaaattcagagaatagaaaatattttgaaataatttttgttaatttactaaatgaataaaaactggatggagrtgaggggcttcatcctgatgacaaaggggtaaatgaggcttgcatggcttaagactatctaggactcacacttttgtgagagatatggatactgaaaata

SEQ ID NO: 72109 - DNA, 201 bp, Homo sapiens
tgcagtgtgaattgagttggggaataagacatacagaaggcagaagaagtttaatatcaccaggttttgctgccttcccgcacttggaagttaggtattaktttttactatatggaggaggaaatgaaggatggaaatagaagaaaattagcagttcaattttaaaagttcaattgaatgaggttgtgggagtattttaag

SEQ ID NO: 72110 - DNA, 201 bp, Homo sapiens
aatatatattgtagaatgcctaaagagctaaataacatatgcattacctcatatgctcatctttttttgtgattacagcacttaaaatttacactgtcaaacaattttcaagaattcatcattgactatagtcactatgtggtgcaatagatttcttaaacttacttctccgatctaattgaaatgttgtttcctttgatc

SEQ ID NO: 72111 - DNA, 201 bp, Homo sapiens
aatgtttagtaaataaaatcaatgcagtgtgaattgagttggggaataagacatacagaaggcagaagaagtttaatatcaccaggttttgctgccttcccgcacttggaagttaggtattagtttttactatatggaggaggaaatgaaggatggaaatagaagaaaattagcagttcaattttaaaagttcaattgaat

SEQ ID NO: 72112 - DNA, 201 bp, Homo sapiens
ttaggttaattgcttttcacatgtctccacatattcattcagtcaaaactatattcatttactaagcatgcaagtaagttaaatagaacttcagaactcargcagagtagacattccattaactaatctgtgtactctttgcaaatcttcacattccctgttccaacatctacattgcatttaaaaccaacgtttttgtct

SEQ ID NO: 72113 - DNA, 201 bp, Homo sapiens
tccaataaaaattcaaattatgctaaggtgtagtgattaacctgatgtcacataaattcaccatgctagagtagttatgatattattttcaatttcaaatkttgattgaggaaaagatgctaaaaaattaggactctgggtgcagtcatccatttgttcattaagtcatgtatttagcaagcatgctaagtacttttaagc

SEQ ID NO: 72114 - DNA, 201 bp, Homo sapiens
atatatgtgtatatatatgtgtatatatatatgtgtatatatatatgtgtgtgtatatatatatacgtgtgtgtatatatatatatatacgtgtgtgtgtrtatatatatatatatatatatatatatatatatatatatgtgtgtgtatatatatatctcctggtaaaaatctgaattataccaaggagtaatacattaa

SEQ ID NO: 72115 - DNA, 201 bp, Homo sapiens
atcttggtagactctttgcgaaagaatcgcgtggctcatcaaatgtttacccaaacacttctcaatatggaccaaaagatcaccagtgtaaaacgtaaggytgcatctaacacgataaatatgttaaattttccagaatatattcaactccaaggcccatgcagtgttatctgtgatctacctacagtttcatttctaaac

SEQ ID NO: 72116 - DNA, 201 bp, Homo sapiens
ccttctctggacagctatcttctacctgaaacacagtgtgctcatgcttttttttgagcatctgctcgttatttaaattcttacaatgttttttatttgaygtatttgcatatctatctttccacttgactgtaagcttgaacatgtaagaacatttcctcaaaatggtaccctcacaactagcagagtatttttcacaaa

SEQ ID NO: 72117 - DNA, 201 bp, Homo sapiens
cctggaggcagattctgtttgcaagatccacgaggagaaggacttcattgctttctgttcttcaacaccacgtatgtgtcttttagtaacagtcaaaaatktgggggtgctgaggccacctttgaatgattctatgaaatcaagataggccctatgcaacaatgagctgagagaatggtgtgtgctctctatatattttgc

SEQ ID NO: 72118 - DNA, 201 bp, Homo sapiens
agaatttatagattatgaaaagaggctctcaagccaaatgtcttgaattgttttttataaatattattttatttatttaattggcaaataaatattttatrtacttatgtacaaaatgatgtttgaaatatatattgtagaatgcctaaagagctaaataacatatgcattacctcatatgctcatctttttttgtgatta

SEQ ID NO: 72119 - DNA, 201 bp, Homo sapiens
catggtaaatctaggaggtcctattaattgtgatgcttctctgactgaagttagacattgctcttttataggatatggagtcagtgctgagggcatttgcygccagaccagagcacaagtcctctgacagcacgttcttggtactcatgtctcatggcatcctagagggaatctgcggaactgcgcataaaaagaaaaaac

SEQ ID NO: 72120 - DNA, 201 bp, Homo sapiens
caaagtgctgggattgcaggcatggcccactgtgctagcctaggatttttttttttttttaagaaagaattaagccttaaaaatctattgtgcaagaaccyaacttttactcaggagctgagaaggaagaagcctcaaaccacccatttcctgctttttagagatagagtctagtggaaccatggctctaactgggtcaag

SEQ ID NO: 72121 - DNA, 201 bp, Homo sapiens
actcccttggcgggccggatggcggaccccggcccagatcccgaatctgagtcggaatcggtgttcccgcgggaggtcgggctctttgcagactcttactyggagaagagccagttctgtttctgtgggcatgtgctgaccatcacgcagaactttgggtcccgcctcggggtggcggcgcgcgtgtgggacgcggtgagg

SEQ ID NO: 72122 - DNA, 201 bp, Homo sapiens
caagtcagaaagctggatgtcatcttgtccctcactttctcccctcacattccagcaatcacccagtcctatgagttaaatgttcttttttttttttttttcctttttgagacagagtctcactctgtcacccaagctgcaatgcagtggcatgatctcggctcaccgcaacatccgcctcctgggttcaaccgattctcc

SEQ ID NO: 72123 - DNA, 201 bp, Homo sapiens
ttcaaccgattctcctgcctcagcctcccgagtagctgggattacagatgtctgccactatgcctcactaatttttgtgtttttagtagagacagagtttygccatgttggccaggctggtcgtgaactcctggcctcaagtgatctggccacaacttccagttgtctggggaagtattatcttttcagcatctctagttc

SEQ ID NO: 72124 - DNA, 201 bp, Homo sapiens
taaaaattcttacaatgtcatctccctaggaatgtaaattaacatgtctttgttcatagggacagaactaggtcatattaagggaagcctagccgggcgcrgtggctcacacctgtaatcccagccctttgggaggccaaggtgggtggatcacctgaggtcaggagtttgagaccagcctgaccaacatggtgaaacccc

SEQ ID NO: 72125 - DNA, 201 bp, Homo sapiens
taagagaaacaagcttatgagtttccaagggttaggatgtgttttgtaggaagcggggtaggaattagacactgcagacttggaaaaggaaaaggtaaggraaaatttgcttctcttttgtcaagaagcaaaaactacagaggaaacagtttcacaaattataatctaatgggcagaaaaaacctcaaactgaaagcactc

SEQ ID NO: 72126 - DNA, 201 bp, Homo sapiens
tacccagcacttagaaggttctccaaattatatctactgcatgaatgaaggtttctgagatgctaatctgaccatcttcacccgtttctgcccttaaagcytactgccctcagtatcgaacctgaatcttcttagcatgtcataatcactttccctttgtctcatgtcttgacacttttctcccccttccacatcctctaa

SEQ ID NO: 72127 - DNA, 201 bp, Homo sapiens; identical to SEQ ID NO: 58049

SEQ ID NO: 72128 - DNA, 201 bp, Homo sapiens
aaaaatacaaaaaattagctgggcatggtggcaggcgcctatagtcccagctactcaggaggctgaggcaggagaatggcgtgaacccgggaggcggagcytgcagtgagccgagatcgcgccactgcactccagcctgggagacacagggagactccctctcaaaaaaaacaaaaacaaaaacaaaaaacaagtactaaa

SEQ ID NO: 72129 - DNA, 201 bp, Homo sapiens
gtgcaatactgttcaaataattctgctaagagcacttcaggtgtgtcactccacagagccatgctaggtatttgagcatataacattgtgcttacgtacayggactgcaaagtcaggcagacaaactgggattcaaatccaggttttgtcttttccagctgtgtgctctggggaagacatacttaacacctgtgggcctca

SEQ ID NO: 72130 - DNA, 201 bp, Homo sapiens
agaaaggggtcccagaggagctgagggcttccttgggcttctttgacaggctatgcttctggcaaaggatattcgagacagggagcgagggggccgtgctraaataggagtgatcgagggagacaaggaggcagccagcccagagctgatgaaggtccttcaggacacccttggccgacgctccattatcaagcctacagt

SEQ ID NO: 72131 - DNA, 201 bp, Homo sapiens
gaagtggagctctccgtgagtaaaaaactcagctcagcaaatggcctaggacagctccggcacattgtagccgctcaatggacatctgagctacctaggarctcaaaccaaaaaaaaccagggttctttcttgattcttttctctccacctacatcagtctatcagctagcttctgttcactcctcttccatttctctgct

SEQ ID NO: 72132 - DNA, 201 bp, Homo sapiens
accatcctggctaacacagtgaaaccccgtctctactaaaaatacaaaaaaaattagccgggtgtggcagcatgcgcctgtagtcccagctactcgggagkctgaggcaggagaatcgcttgaacccagtagacggaggttgcggtgagccgagatcgcgccatggcactccagcctgggcaacaagagtgaaactccatc

SEQ ID NO: 72133 - DNA, 201 bp, Homo sapiens
taagaaagacctcatcctgtgttttctctctcttcttctcaggcaggaaaaacatatgaacaattaaaagaagagctgggagatgctgctgctatcatgcraatcactgctgtgagtcgggttcgctcttgggagaagccagccacatgggcaaccagagccagagaacacacaaatgctacagatgctcacaggcaaaac

SEQ ID NO: 72134 - DNA, 201 bp, Homo sapiens
gagtggagaatagggcaagggaaagcaggatagggaccaaggttcagatccggggtgatgcaagcagagctcacagaagccagagggatggccacgttaaycctgtggctggcagcctcacatcctgtaaggtcattgagaacatctcccctccttctccccaccacctgcaccgaatgacagagaggagagggaggctca

SEQ ID NO: 72135 - DNA, 201 bp, Homo sapiens
cttgttctgtgatgtttcagtcctggaaagacaagcatcatgcctctgaccagtgccttcagggctgtggacaacgaccctgggatcattgtctggagaayagaggtgagctgggctggaggcaccttacttgtgaccactggcatctggaagcagtctggctgcctggggctgctaggcaacagcccgccagcacccctt

SEQ ID NO: 72136 - DNA, 201 bp, Homo sapiens
actttgcccctgatattaaaacaaaaagaggaattccaatgagcttgagaattgtgaggctgggccaagatcagcttcttgcaggtcagcagtctccactractgaggcccttctgggcacagaggagcacactgagccactggggaacccaaggacagagcccctctgctccagggctaccttccgcattcccttaaagt

SEQ ID NO: 72137 - DNA, 201 bp, Homo sapiens
ttctgggctccccctgcctgccaggcttgtgaattgcacaaaggctaaaacctcagttttaaaaacatttctaagcagcttgatgcccttaaatggactayattgcagacttcagcaggaaatcctagatgtccagtctcgtctctttgaatgttccaataagaccggccaattcgttgtcactgagatcacagacttcac

SEQ ID NO: 72138 - DNA, 201 bp, Homo sapiens
tccagtaagactcttccaaattcatggaaatgacaaatctaacaccaaagcagtggaagttccagcctttgcctcctccctaaactccaatgatgtctttmtgctgcgaactcaggcagagcactacctgtggtatggcaaggtaggatggctgggccccgggtcagaccagcccctcggagcccagacctgcactcccct

SEQ ID NO: 72139 - DNA, 201 bp, Homo sapiens
ggatggagggatggtgacagatttgacaaatgcttaggaggtaaagttggtcagccctggtgactcattggatatggggggtttctaggaaactctcaggyttctgccttaggtgactagatagataccacctatcaaaagtggagactcagatacaagtttagtaaagaagagctacatcctgaaggtgttatttttaag

SEQ ID NO: 72140 - DNA, 201 bp, Homo sapiens
tgtcagcagtgaccaaaagaaagcccgggttttttttccaggggtgatgtttgagaatgatgtttgaaactcaccatcctgggcattttcccaccttgctytggaaaaatccagccatcctatcatcatcctatcatcattttagtcttaggatcaatagcaacggactccacatgcagaggatatgggcctttgggggaa

SEQ ID NO: 72141 - DNA, 201 bp, Homo sapiens
catggacccaaaaggggggattttcatttttacttatccttgaaatgtcttctgactccctggctcttttgcttttcctgaagacacagaccagacctaaratgtccctcccctataagaaagacctcatcctgtgttttctctctcttcttctcaggcaggaaaaacatatgaacaattaaaagaagagctgggagatgc

SEQ ID NO: 72142 - DNA, 201 bp, Homo sapiens
agaagttggattcaggaagctgaagttcagagacagctccaatttggaaaggcagacctggaagatacacatagcaattaaaatgataaacatcaagctgrttctgggaaaacctttctctgctgaacaaattaggctgagaaagttttctgaggctgtgaattgctcacgaaagaaaggggaaagatagggtaatgtgta

SEQ ID NO: 72143 - DNA, 201 bp, Homo sapiens
tttctaggaaactctcaggcttctgccttaggtgactagatagataccacctatcaaaagtggagactcagatacaagtttagtaaagaagagctacatcytgaaggtgttatttttaaggtgcttagagcagtcaagaggaggtgttctgcaagaagttggattcaggaagctgaagttcagagacagctccaatttgga

SEQ ID NO: 72144 - DNA, 201 bp, Homo sapiens
tgggcttctttgacaggctatgcttctggcaaaggatattcgagacagggagcgagggggccgtgctgaaataggagtgatcgagggagacaaggaggcasccagcccagagctgatgaaggtccttcaggacacccttggccgacgctccattatcaagcctacagtccctgatgagatcatagatcagaagcagaaatc

SEQ ID NO: 72145 - DNA, 201 bp, Homo sapiens
cctcccaaagtactaggattataggcatgaccaccacacctggccagtacatcttaaaaatgatttctgatccacgttgaataatgatggcctataaataytttttcttgcacttgccttgttgggttttgatatcaaggttatttttattttaaccttataaaatgaactggggagtcttctttttttattctctcagtt

SEQ ID NO: 72146 - DNA, 201 bp, Homo sapiens
tgagagacaaataagacttctgcctgcttaacgctctagccggttccttgacagtgctggctgttatatagcaggccttccaaatgcttctggcatgaacmaataccaccaggagtaatgaagaagtcacttttggccaggcatggtggctcatgcctgtaatctcagcactgtgggaggctgaagtgggcagatcccttg

SEQ ID NO: 72147 - DNA, 201 bp, Homo sapiens
atctttgaaaataatagtgcagtgtcacagtcaggatattggcattgatgcagtcaagatgcagaacaggttcatcactttcctggccttttctcaagttygcattgtgataaaagtgctgacatgagaagatagatatgtttatgtgtatgtgtgtataaatatctataaatatgtatataatctgtatatgaaagctcc

SEQ ID NO: 72148 - DNA, 201 bp, Homo sapiens
attataggcatgaccaccacacctggccagtacatcttaaaaatgatttctgatccacgttgaataatgatggcctataaatattttttcttgcacttgcyttgttgggttttgatatcaaggttatttttattttaaccttataaaatgaactggggagtcttctttttttattctctcagtttgtgttagtggcagagt

SEQ ID NO: 72149 - DNA, 201 bp, Homo sapiens
agtgcagtgtcacagtcaggatattggcattgatgcagtcaagatgcagaacaggttcatcactttcctggccttttctcaagtttgcattgtgataaaartgctgacatgagaagatagatatgtttatgtgtatgtgtgtataaatatctataaatatgtatataatctgtatatgaaagctccaatttcaactgttac

SEQ ID NO: 72150 - DNA, 201 bp, Homo sapiens
taaaagcatgaattatgagaaacatttctcttgagaaagaaaaagacatctttctttcccccatcaccttagcaccacaagctgtgttgggcaggtgaatrgggccatcctgcatcgttctttcttccttggctgtgcctttgctgggtggccaggtaggcagcctcagctagagaaaccatagctgcgtgtgctggcttc

SEQ ID NO: 72151 - DNA, 201 bp, Homo sapiens
aggctggagaacgcactctcactctgacgacagcctggcattgtggggctggcagtgacatctgtggtccctgctctaaggacagtggggaaatgcctgcrtttctcacagaattacaagtacaaatcttgacgctaggtggcagaattaggctgcattaatcttgacctcttttgcttccttatttctttctctacatag

SEQ ID NO: 72152 - DNA, 201 bp, Homo sapiens
cctggcattgtggggctggcagtgacatctgtggtccctgctctaaggacagtggggaaatgcctgcgtttctcacagaattacaagtacaaatcttgacrctaggtggcagaattaggctgcattaatcttgacctcttttgcttccttatttctttctctacatagcattaaaactagcaaatgcttttcttgtaaaaa

SEQ ID NO: 72153 - DNA, 201 bp, Homo sapiens
agttcccatggcttttccactcaagttaggatttcttggtttaagccaggtagggtaaaaggtggagctgagtttggtgactgtgcttattgtcaaatgcygcttcttccatatgttgcagtctaatgctggcgtgctatgcgggacacctagatgttgtgaaatatctccgaagacatggcgcttcttggcaggctagag

SEQ ID NO: 72154 - DNA, 201 bp, Homo sapiens
tccattttccctggagttgctaccatacagctgcagaggaagcgctgtgcctgcaggccatgcaaagccacagtggtcttttggggttgcaggggggctgytgggaccctgcatgtgccaggctcatgccccctgctgtgtgtgccctggagggagaagctcatgcacaccaccctgggttttgttttctaggtggctgtg

SEQ ID NO: 72155 - DNA, 201 bp, Homo sapiens
atgcaaagccacagtggtcttttggggttgcaggggggctgctgggaccctgcatgtgccaggctcatgccccctgctgtgtgtgccctggagggagaagytcatgcacaccaccctgggttttgttttctaggtggctgtgttaaataatcatgaagagttagttcagttacttcttgacaaaggggcagatgcaagtgt

SEQ ID NO: 72156 - DNA, 201 bp, Homo sapiens
catgatctcaatgtcctggtgttgtactctgtatgatctcttccttttttagtgtggatgggatcactgctcagccttttggatgaaatcgagtgaacgtragtaggatctgtgacttgtttctaactgacgtaatattgcaaatgtgatgggttgttactcctgggatgtgtgtgtgtgtgtgtgtgtgtatgtgtgtgt

SEQ ID NO: 72157 - DNA, 201 bp, Homo sapiens
gtttcccatgatctcaatgtcctggtgttgtactctgtatgatctcttccttttttagtgtggatgggatcactgctcagccttttggatgaaatcgagtraacgtgagtaggatctgtgacttgtttctaactgacgtaatattgcaaatgtgatgggttgttactcctgggatgtgtgtgtgtgtgtgtgtgtgtatgt

SEQ ID NO: 72158 - DNA, 201 bp, Homo sapiens
gataggcagacttctaagatgtttcccatgatctcaatgtcctggtgttgtactctgtatgatctcttccttttttagtgtggatgggatcactgctcagrcttttggatgaaatcgagtgaacgtgagtaggatctgtgacttgtttctaactgacgtaatattgcaaatgtgatgggttgttactcctgggatgtgtgt

SEQ ID NO: 72159 - DNA, 201 bp, Homo sapiens
aacaagtatttattatctgtgataggcagacttctaagatgtttcccatgatctcaatgtcctggtgttgtactctgtatgatctcttccttttttagtgyggatgggatcactgctcagccttttggatgaaatcgagtgaacgtgagtaggatctgtgacttgtttctaactgacgtaatattgcaaatgtgatgggtt

SEQ ID NO: 72160 - DNA, 201 bp, Homo sapiens
gatctatagtgataactcttcactccttatattctaacttgtgcctaattagttaggcacaactctaattagttatctattgctgcataagaaattacctraaacttaatgtcttcaaacaacaacaagtatttattatctgtgataggcagacttctaagatgtttcccatgatctcaatgtcctggtgttgtactctgt

SEQ ID NO: 72161 - DNA, 201 bp, Homo sapiens
aaaacttaccagccttttaatctaaattgtcttattgtgataggcttgcttatagtaaaacaaactctttttagtatctgtaggatctatagtgataactsttcactccttatattctaacttgtgcctaattagttaggcacaactctaattagttatctattgctgcataagaaattacctgaaacttaatgtcttcaa

SEQ ID NO: 72162 - DNA, 201 bp, Homo sapiens
aaggctgtgagacttcaaataaatgagtagcctctctgagcattaggtttgtcctctgtaaaccaggaataatttttactgaaccagggttgttctaaggrttagtgaaatgtatgtaaagcctttagcatttaataggtgatcaaatggtaagtgatgcttatagaatgtttttatcatggtaaaatatacaaaacataa

SEQ ID NO: 72163 - DNA, 201 bp, Homo sapiens
ccagtcccagccatctttagttggtctctattcaaacattgtacttttgtttcttgattacatcttcaattattttagttatttctgagattctcccctgyagtttctccagttatctagagaagagtgtggcaaggtacaaagagtgcctgaataacattatgaaggctgtgagacttcaaataaatgagtagcctctct

SEQ ID NO: 72164 - DNA, 201 bp, Homo sapiens
agaaacttttaagagaacaaaaataaagggaactcctgagctcaagcacttctcccatctcggcctcccaaagtgctgggattacaggcatgaaccactgyaccccgcttagtgtgctgtttttaaaaatgacttttgggcttgtgttcatgtgactgatgagcctgtagttttactttttgtaattttttagactacttt

SEQ ID NO: 72165 - DNA, 201 bp, Homo sapiens
taatcttagggacagggtctcactatgttgcacaggctggagtgcagtggctattcacagtcaagttccagtgatcctcccacctcagcctcttgagtagmtgggactacaggctgcagaaacttttaagagaacaaaaataaagggaactcctgagctcaagcacttctcccatctcggcctcccaaagtgctgggatta

SEQ ID NO: 72166 - DNA, 201 bp, Homo sapiens
ggcaatcatttggcctgtacatgttgcttttattttttttctggacttaagatatagaccaaaccttgacatttctggcctttgagtctttcacaactgtkattataatacattagctcttctagaagttagaagtgactttggattaagtctttcataaggtggctaaatgaatttatatggctcatcagaattcactag

SEQ ID NO: 72167 - DNA, 201 bp, Homo sapiens
gaaaacatgagattccagtctacttgaatcagcggaagaaggaagtcccctctgctttaactattacaaaaaagtaaccgaagtagcttgatgttaaccamtcaggtttttctattctgtttccttgttgctacctcataaaacctgtggttctgctattgcccagtgggagctctcattctgttttgtagagtggaaggt

SEQ ID NO: 72168 - DNA, 201 bp, Homo sapiens
aaatgtggtgaaagttaaatgaataaataaagcatccacactagtacatgacccaaattaagtgtcatataagtgttgccgcattgcagttctcctcagtracggcctgtgacctgccatttctgtcggctcttaccaaggctcggtgccgccccgggcctctgctccattgtcatagtaatgtttgcactctgctagtca

SEQ ID NO: 72169 - DNA, 201 bp, Homo sapiens
tggcttctggttattttgggggtaatccataacagtctaccattcctggtgtttggttttagtgggctgtgaaaaaaatcatttgttcaacactgatgtcrtgatacaaggacgtgaagatgtgagtcattgtgacatcaccagccagaattgctgggattcagtgagatgactcacagtaagaggtcagtgtctggttca

SEQ ID NO: 72170 - DNA, 201 bp, Homo sapiens
cctatcaaggctaatttttagtccttctagactcagaaaaaccaccaaaaccctggattacattcgcctgtctgttttgtttatctagagtgtagtctccktattagaagaaaggaaaaaaaagcagaggccaaagaagtcttgtgtctgctgatgagagcaccactcatctgcgaaacgcacgtaaaacaaagtgaaccg

SEQ ID NO: 72171 - DNA, 201 bp, Homo sapiens
aaaaaataacaccaacattacagattttttttttttttaatcttagggacagggtctcactatgttgcacaggctggagtgcagtggctattcacagtcaygttccagtgatcctcccacctcagcctcttgagtagctgggactacaggctgcagaaacttttaagagaacaaaaataaagggaactcctgagctcaagc

SEQ ID NO: 72172 - DNA, 201 bp, Homo sapiens
gattccacaattattataagcagaaacaaattaaaaggttgtatacctactgtttgaaaaacacgacttaccaaaccaaacataagaagtatgtatacccstatatttatgaaataaatagaatccataatttaaaacttcctcacaaaaacaatcccaagttcctgatggcatcactggtgaattcttcaatgaaaggga

SEQ ID NO: 72173 - DNA, 201 bp, Homo sapiens
acttgggaagctgaggcggggggactgcttgagcctaggagtttggattcagcccgggcaacatgtcgagaccccatctctaatttttttttaagttttawtttttttaatttaaataaacatattcaggctagtgcacgtactttggttctctactgaagtaattcaccctaaattgaaactagcattgctagtttagtg

SEQ ID NO: 72174 - DNA, 201 bp, Homo sapiens
tttaaaatccccatcaaaatggtaaaattcattgtgatcctgacctctgatgctgtcagccacaggaaggggcaaaacgacttgaggcttgaagccgtgtstttcccgaagctcaggttcaccaaacatggtctccagatggagtctgttcctcagaacctgggctttacttcttgatgggagaaggaagcagtgttaaaa

SEQ ID NO: 72175 - DNA, 201 bp, Homo sapiens
agtgtcttttaaacagtcatgttttaaaatccccatcaaaatggtaaaattcattgtgatcctgacctctgatgctgtcagccacaggaaggggcaaaacracttgaggcttgaagccgtgtctttcccgaagctcaggttcaccaaacatggtctccagatggagtctgttcctcagaacctgggctttacttcttgatg

SEQ ID NO: 72176 - DNA, 201 bp, Homo sapiens
ctcatgtagtcttagccccgaagaatattaagtctatcaattaggttataattcaaatcttatcaagaaataaatgcttaataaatcaagattaaaaaaawttttcaaagcagtgtcttttaaacagtcatgttttaaaatccccatcaaaatggtaaaattcattgtgatcctgacctctgatgctgtcagccacaggaa

SEQ ID NO: 72177 - DNA, 201 bp, Homo sapiens
acctcctgcaacccttccctggcttcctaaagtggtggtgccccctctctgatgttattctatctctgcgcttttctcttaatagtaataatcagaacttrtaattattttgttaatatttaaaatctagctggacgtggtggctcacgcctgtaatcccagcattttgggaggccaaggcgggcggatcacctgaggtca

SEQ ID NO: 72178 - DNA, 201 bp, Homo sapiens
aatctttgcctaaatttcacctcctgcaacccttccctggcttcctaaagtggtggtgccccctctctgatgttattctatctctgcgcttttctcttaayagtaataatcagaacttgtaattattttgttaatatttaaaatctagctggacgtggtggctcacgcctgtaatcccagcattttgggaggccaaggcgg

SEQ ID NO: 72179 - DNA, 201 bp, Homo sapiens
ggtagataagagatctaaggtatttcagtgactaagaaactgaggtgaatgactaagggactgagacttctctctccaaacctgtttctccactagtcttycaagccttcccagttactccaacctgaaaatgagtcatccttggctcctcattatcaaccctcaccccacccttctccatccaccagcaggtctgtttat

SEQ ID NO: 72180 - DNA, 201 bp, Homo sapiens
atattatgttaacagtacattgtttatgccgatattatctaacatattttaaaccctgttccttttgttactgagaggtctaaaataacattttacaagtrtagttgaatatagcatcagtaaattggttatgaggaagactccttcataattgcttttaaggattaaacatgtatctaaggacaacaccaaggaactact

SEQ ID NO: 72181 - DNA, 201 bp, Homo sapiens
tggtagagacagggttttgccatgttgcccaggctggtctcaaactcctgaacttaagcattcctcccacttcggtctcccaaagtgctgggattacaggmgcgagccatcgttcttggcctgcaagttatgacttcctttcagagtctttctatctgtagtacagtcctcctgtgcaagattgttttttgactgcttttt

SEQ ID NO: 72182 - DNA, 201 bp, Homo sapiens
ccgacctgcagcttgagctgctccaccaggcgctgcagggcactcttgctggccctggaagacatggtagcagcagtgtgctccaagggtggttgagccaygctaggcgggtcagccctgccaggccctgagcgtgggcactgccaatattgttgaaaggaccatactatccaaagcaatctacagattcaatgcaatctt

SEQ ID NO: 72183 - DNA, 201 bp, Homo sapiens
gggttttgatatcaaggttatttttattttaaccttataaaatgaactggggagtcttctttttttattctctcagtttgtgttagtggcagagttttttktgtttggttggttggtttctctttttcttgtatgtttcatggaactttttggtgaaggcacttgggcctggaaatttctttatggcaagttttttcatta

SEQ ID NO: 72184 - DNA, 201 bp, Homo sapiens
cacacctgtgggtatttctcatcaggtgggacaagagactgagaaaataaataagacacagagacaaagtatagagaaagaacagtgggcccaggagaccrgtgctcagcatacggaggacctgtaccagcaccggtctctgagtttcctcagtatttattgattactgttttcactatctcagccagaggaatgtggcag

SEQ ID NO: 72185 - DNA, 201 bp, Homo sapiens
cagacgtggcatcaagtattacagtgaattacagttatactgtcagcaatattatgttaacagtacattgtttatgccgatattatctaacatattttaarccctgttccttttgttactgagaggtctaaaataacattttacaagtgtagttgaatatagcatcagtaaattggttatgaggaagactccttcataatt

SEQ ID NO: 72186 - DNA, 201 bp, Homo sapiens
ttgtatccaaccagatttcacctgagacggaagttatttcctactgtcagccataatggaagcactacagacgtggcatcaagtattacagtgaattacarttatactgtcagcaatattatgttaacagtacattgtttatgccgatattatctaacatattttaaaccctgttccttttgttactgagaggtctaaaat

SEQ ID NO: 72187 - DNA, 201 bp, Homo sapiens
atctttgaggtttcttttaacttggagatttgtatccaaccagatttcacctgagacggaagttatttcctactgtcagccataatggaagcactacagaygtggcatcaagtattacagtgaattacagttatactgtcagcaatattatgttaacagtacattgtttatgccgatattatctaacatattttaaaccct

SEQ ID NO: 72188 - DNA, 201 bp, Homo sapiens
gtctgcagaatgacccagcaaagaatgagggcaagggattccaggcagtgggaattacttgtacataggccctgagacctgagagcagcgtgggtttgagkctcacggtaggaagattagtaaagctgtagctaaggagaggaggaggaaaaaacagggttggaaggagggaggagaaatgagataaggctggaaaattca

SEQ ID NO: 72189 - DNA, 201 bp, Homo sapiens
agaggagatggacaaaggctcccaagaggaagtagtactgggtctgcagaatgacccagcaaagaatgagggcaagggattccaggcagtgggaattactkgtacataggccctgagacctgagagcagcgtgggtttgaggctcacggtaggaagattagtaaagctgtagctaaggagaggaggaggaaaaaacagggt

SEQ ID NO: 72190 - DNA, 201 bp, Homo sapiens
tggcaggaggccacataaacatttctgcttctctgtgacttatgggtagcattgatataaattgttaaaaataatgatcgtagatagataatgtatcagartttgggctcagccgctgtagctgctgttgacccagaggaaccactgggatcctcacatctcagggcagcacatcgtttgcagcaatggttggttctgtac

SEQ ID NO: 72191 - DNA, 201 bp, Homo sapiens
cagctctgttctagggattgaggattgaacaacggatcggacagtgttagttttggtcatcccaggaaaactaagcagaggcttgctcaagaactcctgasgtcttggtggggttcggagattgggggaagaggagatggacaaaggctcccaagaggaagtagtactgggtctgcagaatgacccagcaaagaatgaggg

SEQ ID NO: 72192 - DNA, 201 bp, Homo sapiens
attcattcatttatagtgcctgttatgttgcagctctgttctagggattgaggattgaacaacggatcggacagtgttagttttggtcatcccaggaaaaytaagcagaggcttgctcaagaactcctgaggtcttggtggggttcggagattgggggaagaggagatggacaaaggctcccaagaggaagtagtactggg

SEQ ID NO: 72193 - DNA, 201 bp, Homo sapiens
gttttcatgtgtaaactataatttcaagttcttcagtgctgtctttatccattcattcatttatagtgcctgttatgttgcagctctgttctagggattgrggattgaacaacggatcggacagtgttagttttggtcatcccaggaaaactaagcagaggcttgctcaagaactcctgaggtcttggtggggttcggaga

SEQ ID NO: 72194 - DNA, 201 bp, Homo sapiens
cgaggctgggtcttgtatttattagagaccccgtcttactccccgccccccgccccacacccctagtctgcgacttgaaggagagagagagaaaagaagarctttgtccaagtgtatttgattcattcttaggggttctacaagttaggacactcaaaaaatgtttgtaatctctttttctgttttcccatgttgctttcg

SEQ ID NO: 72195 - DNA, 201 bp, Homo sapiens
tcttcaaactcatcacacatctgatcttagatgtattatgcttcaagcacattggtcttcttgtagtccctcaaacaagcttctttcaggactgtggctcwgaacaagctttcctctctgccagggatgctattccctcctgctatggcaggtctgactcctaatgtccttcaatctttgcctaaatttcacctcctgcaa

SEQ ID NO: 72196 - DNA, 201 bp, Homo sapiens
attttccattttccctggagttgctaccatacagctgcagaggaagcgctgtgcctgcaggccatgcaaagccacagtggtcttttggggttgcagggggrctgctgggaccctgcatgtgccaggctcatgccccctgctgtgtgtgccctggagggagaagctcatgcacaccaccctgggttttgttttctaggtggc

SEQ ID NO: 72197 - DNA, 201 bp, Homo sapiens
cctttttattgccaaatagtaatccattgtataaatactacatggtttgcttattggtttgtcattggaggaatatggactattttcactttttggtaaaytataagtggattggaattcacaaagtgctttttgtctgagcataggttttcatttcacttgtgcaaatgactaagggtgtaggattgctgagtcacatgg

SEQ ID NO: 72198 - DNA, 201 bp, Homo sapiens
ggaagactggaaaatgtaggctggactgagaacttgtggatagacacacctcagtgattagtgaaaaggaagattggtccaaagcaatgtttgttaaccawattttcattatcaaagaggaaaaactaaacattccctaacagaaatgaaaaaggaataaaatttttgttagatgatgttgaactttgaaaggccaccaag

SEQ ID NO: 72199 - DNA, 201 bp, Homo sapiens
tagtgttcttttgtggtgctttagaaattctggcttacttgtatttttgctggccttctaatgatttcactcatcaatcagaagatatttgtgtccacctycctgcttcctctccggtgatcttgtctattcttggccattttagagttgacttagcagccttcacaaaactggttggaatttccactgggattaaattga

SEQ ID NO: 72200 - DNA, 201 bp, Homo sapiens
gagagagggatattctggaaaactttctgctaggttgctaagttataattttcacagatacactctcattatctgttccacacagagataagtattaataygaatacctcattttcatttatattttaattaaatgccatttgaaaaaaacagaaatgcatcttcattacatgctaccatttaagaatacattaaaaatgg

SEQ ID NO: 72201 - DNA, 201 bp, Homo sapiens
atctcgaaaaaacaaaaaaaagaactttatttcttcagatttatgttactgttttcatgtgtaaactataatttcaagttcttcagtgctgtctttatccmttcattcatttatagtgcctgttatgttgcagctctgttctagggattgaggattgaacaacggatcggacagtgttagttttggtcatcccaggaaaac

SEQ ID NO: 72202 - DNA, 201 bp, Homo sapiens
cccagaatatgatctctcaccaccgccatccagataattcttcaggttttgacgtttcccaacctgtctgctggttacttttcagagtacttggatcattrctatttatattttgtccagagtttcaaattgtgatcagtggaaatgacaggccgtagcatacatacgccatcctggccagcatcacaggtggtcagtaca

SEQ ID NO: 72203 - DNA, 201 bp, Homo sapiens
cttatgctaaatgctgtgtcatcaaactgaaactttaaggaagcagatagatccccaaacagaccagtttttcctgaaaacatgagattccagtctacttraatcagcggaagaaggaagtcccctctgctttaactattacaaaaaagtaaccgaagtagcttgatgttaaccaatcaggtttttctattctgtttcctt

SEQ ID NO: 72204 - DNA, 201 bp, Homo sapiens
aaagagaacccctgtaatcgatcagggaccccatctgccttctctgtgggcgtaggataaattcttttgattatgtctatttgatataaaaaaatctgtarttaaaatataccatttgcattatccataatagccaaagggtggaagcaagccaagtgtctatctgcaaatgaataaacaaaatatggtatatatatacac

SEQ ID NO: 72205 - DNA, 201 bp, Homo sapiens
ataggtttatgaagaaggcattttaaaaagagaacccctgtaatcgatcagggaccccatctgccttctctgtgggcgtaggataaattcttttgattatytctatttgatataaaaaaatctgtagttaaaatataccatttgcattatccataatagccaaagggtggaagcaagccaagtgtctatctgcaaatgaat

SEQ ID NO: 72206 - DNA, 201 bp, Homo sapiens
aaatgcagtgctgtgtgaatggtgcctaccttcgtgcccggcctgtcaagaccaggcagtttacacaaaaacacttgatattgactatgaaacaagatccrgaagagaacaaatataaatacagatggatcagctaaatgaaggactgtcgagtaaaaacacaaagaagatgtttgtgagtggagggggatggatctcctt

SEQ ID NO: 72207 - DNA, 201 bp, Homo sapiens
cttcataattgcttttaaggattaaacatgtatctaaggacaacaccaaggaactactagaaataaccctcgagtcagtcttttccgttctgtttccacasccttagttttctattacttttaggaatgacctttgttaactaagtcattaaaatccaataaacataaactcttcagaccccacagctggatcatactctt

SEQ ID NO: 72208 - DNA, 201 bp, Homo sapiens
tgccgatattatctaacatattttaaaccctgttccttttgttactgagaggtctaaaataacattttacaagtgtagttgaatatagcatcagtaaattsgttatgaggaagactccttcataattgcttttaaggattaaacatgtatctaaggacaacaccaaggaactactagaaataaccctcgagtcagtctttt

SEQ ID NO: 72209 - DNA, 201 bp, Homo sapiens
caggaccactgtgggatcaaaacagaactggtgaaacaaagaacaagctgctttctgttctggttttagtgtggagagagggagtccattttccattttcyctggagttgctaccatacagctgcagaggaagcgctgtgcctgcaggccatgcaaagccacagtggtcttttggggttgcaggggggctgctgggaccct

SEQ ID NO: 72210 - DNA, 201 bp, Homo sapiens
agcaatgtttgttaaccatattttcattatcaaagaggaaaaactaaacattccctaacagaaatgaaaaaggaataaaatttttgttagatgatgttgarctttgaaaggccaccaaggacacttttaatatcaaatcttcctcatccccccaactccagaaaactagtttttgctcagatattggctcagtggaaaatg

SEQ ID NO: 72211 - DNA, 201 bp, Homo sapiens
ttaaggactaaagaacccctgtccccaggaccactgtgggatcaaaacagaactggtgaaacaaagaacaagctgctttctgttctggttttagtgtggakagagggagtccattttccattttccctggagttgctaccatacagctgcagaggaagcgctgtgcctgcaggccatgcaaagccacagtggtcttttggg

SEQ ID NO: 72212 - DNA, 201 bp, Homo sapiens
ggaagttatttcctactgtcagccataatggaagcactacagacgtggcatcaagtattacagtgaattacagttatactgtcagcaatattatgttaacwgtacattgtttatgccgatattatctaacatattttaaaccctgttccttttgttactgagaggtctaaaataacattttacaagtgtagttgaatatag

SEQ ID NO: 72213 - DNA, 201 bp, Homo sapiens
taataaccaggaaaaacgtaaaactcattatagatttgtataataagggcgagttcggggtagtataggcttctaatgtacagtgacaatctcgctctgtygtccaggcaggagtgcaatggcgcgatctcagctcactgcaacctccccatcaccctcccgggttcaagcgattctcctgcctcagcctcccgaatagct

SEQ ID NO: 72214 - DNA, 201 bp, Homo sapiens
agatttgtataataagggcgagttcggggtagtataggcttctaatgtacagtgacaatctcgctctgttgtccaggcaggagtgcaatggcgcgatctcrgctcactgcaacctccccatcaccctcccgggttcaagcgattctcctgcctcagcctcccgaatagctagccgggactacaggtgtgtgccagcacacc

SEQ ID NO: 72215 - DNA, 201 bp, Homo sapiens
caaagtgctgggattacaggcgtgagccaccgcacctggcttactgtagacatctttaacatatcacaatcttccttcaaataataccccactgcttgatsttatgcacaagaaccttacgacagtattcttccaggccccagactctgtgctgttgttatcctctatgttgcttttgcatatcctattaacctcacaaaa

SEQ ID NO: 72216 - DNA, 201 bp, Homo sapiens
ttcccagcctctagtatcctctgttctcttttttacttctgtgtgatcaacattttttttagcttctgtattagtctgttttcacattgctatgaagaackgcccgagactgggtaatttaaaaagaggcttaattgattcatagttctgcatggctgaagaggcctcaggaaacttacaatcagggtgaaagaggaagca

SEQ ID NO: 72217 - DNA, 201 bp, Homo sapiens
gtaatttaaaaagaggcttaattgattcatagttctgcatggctgaagaggcctcaggaaacttacaatcagggtgaaagaggaagcaggcatgtcttacrgggtttcgccatgttggccaggctaggtctcgaactcctggtctcaagtgattggccagccttggcctcctaaggtgctgggattacaggcatgagccac

SEQ ID NO: 72218 - DNA, 201 bp, Homo sapiens
ccttctcttgaggcttggaggcagtcatttatcactttgtacttgaaggcattcctctgcagacttctttcctagagtcttcagggtaaagcacaggatcyggactccaggaggggggttacttcctgctggaacactgaccagcagggcatcctttcaggcattctgcatgcagtactgttgcagctctgcagctgcctg

SEQ ID NO: 72219 - DNA, 201 bp, Homo sapiens
aacccctggggtcaaatgattctcctgccttagcctcccaaagtgctgggattacaggcatgagccaccatgcctggctaccaactgatttttgacaaagkcagcaagaatactcactggggaaaggataatctcttcaataagtgatgctgggaaaactagatatccataggcagaagaatgaaaatagaccctcacctc

SEQ ID NO: 72220 - DNA, 201 bp, Homo sapiens
tttgtttggttggttggtttctctttttcttgtatgtttcatggaactttttggtgaaggcacttgggcctggaaatttctttatggcaagttttttcatkactgattcaatatatttaatctatgtaagatttttttctactttttgagtcaattttgattttttttttccaaaaattcatatctcaccaagtatggtgg

SEQ ID NO: 72221 - DNA, 201 bp, Homo sapiens
aataaactggaaattgatgcataagtggctttgccacatggagaaggattggctttccaaggcaggttgatttgcatgtttataaacaagaatcatttgcrttatctgttcttttcaacttcacataccataaaacaggtgaaaggctagactagaaaaccttaaaggggctgggtgcggtggctcacgcctgttatccca

SEQ ID NO: 72222 - DNA, 201 bp, Homo sapiens
ctggaaattgatgcataagtggctttgccacatggagaaggattggctttccaaggcaggttgatttgcatgtttataaacaagaatcatttgcattatcwgttcttttcaacttcacataccataaaacaggtgaaaggctagactagaaaaccttaaaggggctgggtgcggtggctcacgcctgttatcccagcactt

SEQ ID NO: 72223 - DNA, 201 bp, Homo sapiens
agaacctgggctttacttcttgatgggagaaggaagcagtgttaaaacttgtctattctgaactagccaaccagattaaaggaggggtttgtgcataccarcatcatcccagaatgacctgaatgactcattacatgcagacagtggtgcaaactcattaacaagtaaacaactcacaccagtgctctgtgctcacagggc

SEQ ID NO: 72224 - DNA, 201 bp, Homo sapiens
tccgggggttcgcccgcggaggccggggagcagccgaccatggagccccagagtaagggaggcccgggctggagctgggaccggggcgggcgaccgggctrgggctccccgggaacgagtgtgggcgccccgcgcgcgactccgcaggtttcaacgctcggacacggaaatacggtttgcgtctcctcgcgcttttctctc

SEQ ID NO: 72225 - DNA, 201 bp, Homo sapiens
gaggcgttaggagtccgggggttcgcccgcggaggccggggagcagccgaccatggagccccagagtaagggaggcccgggctggagctgggaccggggcdggcgaccgggctggggctccccgggaacgagtgtgggcgccccgcgcgcgactccgcaggtttcaacgctcggacacggaaatacggtttgcgtctcctc

SEQ ID NO: 72226 - DNA, 201 bp, Homo sapiens
cctggctaccaactgatttttgacaaaggcagcaagaatactcactggggaaaggataatctcttcaataagtgatgctgggaaaactagatatccatagrcagaagaatgaaaatagaccctcacctctcaccctatatgaaaataaactcaaaatggatcaaagacctaaatgtaagatctgaaactcaaaatggatca

SEQ ID NO: 72227 - DNA, 201 bp, Homo sapiens
gcgacgccggccctggctgagaggcgttaggagtccgggggttcgcccgcggaggccggggagcagccgaccatggagccccagagtaagggaggcccggrctggagctgggaccggggcgggcgaccgggctggggctccccgggaacgagtgtgggcgccccgcgcgcgactccgcaggtttcaacgctcggacacgga

SEQ ID NO: 72228 - DNA, 201 bp, Homo sapiens
agagaggtctgctgtctttctttgtttttctgtagacccccttgcacccaccatagctgcttctaagattttccactgaatcctagcaattacattagaaygctacttggcataattttcttaagtttattctgcttggggttgttggatttgtgggtttatgcttttcatcaaatttaggaaatttggaccattatttca

SEQ ID NO: 72229 - DNA, 201 bp, Homo sapiens
gccggcgccttacccgcgggcaggcccactcgcccgacggacgccgcgggtcggcgacagcggggaccgcgggtcggcgacgtcggggcacaggtcctgcsgggccgcgggggccgccagggagggcgcgaccgcctgaccgggcttcaggagcagtgtcctcagccggtgacctggccgctaccctcgctcagtgtcccc

SEQ ID NO: 72230 - DNA, 201 bp, Homo sapiens
ttgattacagataacttcagtgtgactcaggctcgtttgccacagctgtttctcttaaaagttctctgataagtcattgccaccactacttccaaatagcrtatgttaactttgagttaattttacataaacctgggttaatttacaaaattttggcaccaacaacatggttaggcaaggcagcatggatgggtattggaa

SEQ ID NO: 72231 - DNA, 201 bp, Homo sapiens
attacagataacttcagtgtgactcaggctcgtttgccacagctgtttctcttaaaagttctctgataagtcattgccaccactacttccaaatagcataygttaactttgagttaattttacataaacctgggttaatttacaaaattttggcaccaacaacatggttaggcaaggcagcatggatgggtattggaatct

SEQ ID NO: 72232 - DNA, 201 bp, Homo sapiens
aacataagttttactaatgctataatcagtataaattccttgcagatcaaggacagtgaggccatgtctaataatccagaggcagaacttggatttgggarataactcccccctcttgcactctctgtgacaagtctagtttcgatatcaagtttatcttaatctcaaaaaatgagcttggctctgttccctctattttct

SEQ ID NO: 72233 - DNA, 201 bp, Homo sapiens
ccagaatatgatctctcaccaccgccatccagataattcttcaggttttgacgtttcccaacctgtctgctggttacttttcagagtacttggatcattgytatttatattttgtccagagtttcaaattgtgatcagtggaaatgacaggccgtagcatacatacgccatcctggccagcatcacaggtggtcagtacat

SEQ ID NO: 72234 - DNA, 201 bp, Homo sapiens
ctcaggctcgtttgccacagctgtttctcttaaaagttctctgataagtcattgccaccactacttccaaatagcatatgttaactttgagttaattttasataaacctgggttaatttacaaaattttggcaccaacaacatggttaggcaaggcagcatggatgggtattggaatctgtcaatctgggttgctgtatac

SEQ ID NO: 72235 - DNA, 201 bp, Homo sapiens
ttacataaacctgggttaatttacaaaattttggcaccaacaacatggttaggcaaggcagcatggatgggtattggaatctgtcaatctgggttgctgtrtaccagctctgggactgggggcaagttgtagcagccctgagcctcctgcttcacctgtatcaggggaggctgagacccaccttgcaggggtcttgtgaag

SEQ ID NO: 72236 - DNA, 201 bp, Homo sapiens
tatcaaagaggaaaaactaaacattccctaacagaaatgaaaaaggaataaaatttttgttagatgatgttgaactttgaaaggccaccaaggacactttyaatatcaaatcttcctcatccccccaactccagaaaactagtttttgctcagatattggctcagtggaaaatgtgtggtctgaagctgtagtctcctagt

SEQ ID NO: 72237 - DNA, 201 bp, Homo sapiens
tttttgttagatgatgttgaactttgaaaggccaccaaggacacttttaatatcaaatcttcctcatccccccaactccagaaaactagtttttgctcagrtattggctcagtggaaaatgtgtggtctgaagctgtagtctcctagtttgtgagcttattttcgctgcctgaaggtttgagtcaccgtagaaggggagga

SEQ ID NO: 72238 - DNA, 201 bp, Homo sapiens
cttaagctacaaacaatagcatgagcgatctgtgccttaaggacatgctcctgctgcagttaactagcctaacctattcctttaattcggcccatcccttyctttcccataagggatactttcagttaatttaacatctatagaaacaatgctaatgactggtttgctgtcagtaaatacgtgggtaaatctctgttgggg

SEQ ID NO: 72239 - DNA, 201 bp, Homo sapiens
aacctattcctttaattcggcccatccctttctttcccataagggatactttcagttaatttaacatctatagaaacaatgctaatgactggtttgctgtyagtaaatacgtgggtaaatctctgttgggggctgtcagttctgaaggctgcgagacccctgatttcccacttcacacctctgtatttctgtgtgtgtgtc

SEQ ID NO: 72240 - DNA, 201 bp, Homo sapiens
ggcctttgagtctttcacaactgtgattataatacattagctcttctagaagttagaagtgactttggattaagtctttcataaggtggctaaatgaattwatatggctcatcagaattcactagattggttaagcaggaaatttacagagatttttttctttgctgtaaatgtttttctaaattgaaaaacttctaatac

SEQ ID NO: 72241 - DNA, 201 bp, Homo sapiens
tgtttttggcaggaggccacataaacatttctgcttctctgtgacttatgggtagcattgatataaattgttaaaaataatgatcgtagatagataatgtdtcagagtttgggctcagccgctgtagctgctgttgacccagaggaaccactgggatcctcacatctcagggcagcacatcgtttgcagcaatggttggtt

SEQ ID NO: 72242 - DNA, 201 bp, Homo sapiens
ataaacatttctgcttctctgtgacttatgggtagcattgatataaattgttaaaaataatgatcgtagatagataatgtatcagagtttgggctcagccrctgtagctgctgttgacccagaggaaccactgggatcctcacatctcagggcagcacatcgtttgcagcaatggttggttctgtacaaccttttatgaaa

SEQ ID NO: 72243 - DNA, 201 bp, Homo sapiens
tatctgtagtacagtcctcctgtgcaagattgttttttgactgctttttcttgacaaatcttgctaaaggtctgtgaattttataatgtatttttaaagarccaggttttagcagggcatggtggctcatacctgtaatcccagcactttgagaggcaaaggtgggaggatcgcttgagcctgtaagggggaggctgtagt

SEQ ID NO: 72244 - DNA, 201 bp, Homo sapiens
acccagccatcccattactgggtatatacccaaatgactataaatcatgctgctataaagacacatgcacacgtatgtttattgcggcattattcacaatwgcaaagacttggaaccaacccaaatgtccaacaatgatagactggattaagaaaatgtggcacatatacaccatggaatactatgcagccataaaaaatg

SEQ ID NO: 72245 - DNA, 201 bp, Homo sapiens
ttaccatgttgtccatgctggtcgcaaactcctggcctcaggtaatcccttcgccttggcctcccaaagtgctgaggttataggcgtgagccaccatgccyggccttgcctttattttttaaagataatgtcactaggtaaagagttctagtttgacacactttccttctgagtactttttttttaatatttaaaaaattg

SEQ ID NO: 72246 - DNA, 201 bp, Homo sapiens
ttatagtaaaaccttccattgtaaacttctggcaatcactgatctgtgttcctctagcattgcttttttttcagaattttatacaaatggaatcgttcagkctgtagcctttgagtctggctactttcatgtactgtatcaacagttattcctttttattgccaaatagtaatccattgtataaatactacatggtttgct

SEQ ID NO: 72247 - DNA, 201 bp, Homo sapiens
tatagtaaaaccttccattgtaaacttctggcaatcactgatctgtgttcctctagcattgcttttttttcagaattttatacaaatggaatcgttcaggmtgtagcctttgagtctggctactttcatgtactgtatcaacagttattcctttttattgccaaatagtaatccattgtataaatactacatggtttgctt

SEQ ID NO: 72248 - DNA, 201 bp, Homo sapiens
tcactgatctgtgttcctctagcattgcttttttttcagaattttatacaaatggaatcgttcaggctgtagcctttgagtctggctactttcatgtactktatcaacagttattcctttttattgccaaatagtaatccattgtataaatactacatggtttgcttattggtttgtcattggaggaatatggactatttt

SEQ ID NO: 72249 - DNA, 201 bp, Homo sapiens
taatactgtcttctggaatactagaaataagtgcaagtgattgtttttggcaggaggccacataaacatttctgcttctctgtgacttatgggtagcattsatataaattgttaaaaataatgatcgtagatagataatgtatcagagtttgggctcagccgctgtagctgctgttgacccagaggaaccactgggatcct

SEQ ID NO: 72250 - DNA, 201 bp, Homo sapiens
cactgatctgtgttcctctagcattgcttttttttcagaattttatacaaatggaatcgttcaggctgtagcctttgagtctggctactttcatgtactgyatcaacagttattcctttttattgccaaatagtaatccattgtataaatactacatggtttgcttattggtttgtcattggaggaatatggactattttc

SEQ ID NO: 72251 - DNA, 201 bp, Homo sapiens
gtgtacgtttgactttatcagaacctgccaaattgtcttccaaagtgctgtgccacttctgtttctttaataaatacaggggtattcaagctgtctgtttsttcttgagttttggtagtctgtctttcaaggaattgatctatttcacctaatttgtagaatttagaagcatatagttgtttgttttgtttttgtagtatc

SEQ ID NO: 72252 - DNA, 201 bp, Homo sapiens
aatttagaagcatatagttgtttgttttgtttttgtagtatccattctagccttctagtgtctacaggatttgtaataatcctttcatttctggtattggyaatttgtgttttctcttcttcctttgtcagtctgctagaggcttcctcatttgattgctttccaccttccaccacccctgcaaagaaccaactttggatt

SEQ ID NO: 72253 - DNA, 201 bp, Homo sapiens
atagttgtttgttttgtttttgtagtatccattctagccttctagtgtctacaggatttgtaataatcctttcatttctggtattggtaatttgtgttttmtcttcttcctttgtcagtctgctagaggcttcctcatttgattgctttccaccttccaccacccctgcaaagaaccaactttggattttgttgaattttt

SEQ ID NO: 72254 - DNA, 201 bp, Homo sapiens
agagttttttttgtttggttggttggtttctctttttcttgtatgtttcatggaactttttggtgaaggcacttgggcctggaaatttctttatggcaagwtttttcattactgattcaatatatttaatctatgtaagatttttttctactttttgagtcaattttgattttttttttccaaaaattcatatctcaccaa

SEQ ID NO: 72255 - DNA, 201 bp, Homo sapiens
ctttttggtgaaggcacttgggcctggaaatttctttatggcaagttttttcattactgattcaatatatttaatctatgtaagatttttttctacttttkgagtcaattttgattttttttttccaaaaattcatatctcaccaagtatggtggcttatgcctgtaatcccagcactttgggaggctcaggtgggaggac

SEQ ID NO: 72256 - DNA, 201 bp, Homo sapiens
ccatccgcgctgggcgtgggtgcaagcgcctgcccctggcaccccgtgcctctctcaggcccccgctgcatttcagcctcattcattgctaagaaatcttygttgtttctaaagaagcagacagaaattaccacaagagagacaccaagagcactttcctgaggtgagaggcacatgtccccttggagggctgagaacgct

SEQ ID NO: 72257 - DNA, 201 bp, Homo sapiens
ttttttaaaaggtttaatatgagtttatatctctaaatatcagtttctaattttttttaaaagcctatgtttacaacaaatttgggagatacctatatgcwctactaactagtgttcttttgtggtgctttagaaattctggcttacttgtatttttgctggccttctaatgatttcactcatcaatcagaagatatttgt

SEQ ID NO: 72258 - DNA, 201 bp, Homo sapiens
ccaccactacttccaaatagcatatgttaactttgagttaattttacataaacctgggttaatttacaaaattttggcaccaacaacatggttaggcaagkcagcatggatgggtattggaatctgtcaatctgggttgctgtataccagctctgggactgggggcaagttgtagcagccctgagcctcctgcttcacctg

SEQ ID NO: 72259 - DNA, 201 bp, Homo sapiens
atactacaaagctgtagtaatgaagacagcatggtactgtcataaaaacagacacatagactaatggaacagaatagaccacacagaaagtaatgtattcrtctacagccaactgctttttaaaaattttttattttttgagacagtgtctcactccatctcccaggctggagtgcaatggcatgatcatggctcactgta

SEQ ID NO: 72260 - DNA, 201 bp, Homo sapiens
tttgttatacaacaatagcaaactaatatagagcttctgtgggtcctgatttgagaaatgctttagctgggtggttctgtcttggtcaatatgttgattargcctgcagtcatccgaaggcttgactgaggctagggcatccaatttcaagacggctcacttaacatggctagcaagtcaatgctgtctgttagcaggaga

SEQ ID NO: 72261 - DNA, 201 bp, Homo sapiens
ggatgttctagaaatgttctagattcctagtttaattctgtcgtcagagaaaataattcactgaattttaattgtttaacttcagggtttgttttatgacycagaatatgatctctcaccaccgccatccagataattcttcaggttttgacgtttcccaacctgtctgctggttacttttcagagtacttggatcattgc

SEQ ID NO: 72262 - DNA, 201 bp, Homo sapiens
gttttgacgtttcccaacctgtctgctggttacttttcagagtacttggatcattgctatttatattttgtccagagtttcaaattgtgatcagtggaaaygacaggccgtagcatacatacgccatcctggccagcatcacaggtggtcagtacatctttctgttgttgttttgagacagggtctcactctgttgcccag

SEQ ID NO: 72263 - DNA, 201 bp, Homo sapiens
ctgtctgctggttacttttcagagtacttggatcattgctatttatattttgtccagagtttcaaattgtgatcagtggaaatgacaggccgtagcatacrtacgccatcctggccagcatcacaggtggtcagtacatctttctgttgttgttttgagacagggtctcactctgttgcccaggctggagcacagtggcat

SEQ ID NO: 72264 - DNA, 201 bp, Homo sapiens
tggcagagttttttttgtttggttggttggtttctctttttcttgtatgtttcatggaactttttggtgaaggcacttgggcctggaaatttctttatggsaagttttttcattactgattcaatatatttaatctatgtaagatttttttctactttttgagtcaattttgattttttttttccaaaaattcatatctca

SEQ ID NO: 72265 - DNA, 201 bp, Homo sapiens
tgtatgtttcatggaactttttggtgaaggcacttgggcctggaaatttctttatggcaagttttttcattactgattcaatatatttaatctatgtaagwtttttttctactttttgagtcaattttgattttttttttccaaaaattcatatctcaccaagtatggtggcttatgcctgtaatcccagcactttgggag

SEQ ID NO: 72266 - DNA, 201 bp, Homo sapiens
tgaggcaggcagatcacgaggtcaagagatcaagaccatcctggccaacatggtgaaaccccgtctctactaaaaatacaaaaattcgctaggtgtggtgrcgggtacctgtaatcccacctacttgggaggctgaggcaggagaatccttgaacccgggaggcggagtttgcagtgagctgagatcgcaccactactgca

SEQ ID NO: 72267 - DNA, 201 bp, Homo sapiens
atgtatgttaaaaagtatctttttttttttttttttttgagacggaatctcactctgtcctccagattggagtgcagtggcgcgatctcagcccactgcargctctgcctcccgggttcacgccattctcctgcctcagcctcccaagtagctggaactataggcgcccaccaccacacccggctaacttcttgtattttt

SEQ ID NO: 72268 - DNA, 201 bp, Homo sapiens
agctgcctcttcaaactcatcacacatctgatcttagatgtattatgcttcaagcacattggtcttcttgtagtccctcaaacaagcttctttcaggactrtggctctgaacaagctttcctctctgccagggatgctattccctcctgctatggcaggtctgactcctaatgtccttcaatctttgcctaaatttcacct

SEQ ID NO: 72269 - DNA, 201 bp, Homo sapiens
ttttccattttccctggagttgctaccatacagctgcagaggaagcgctgtgcctgcaggccatgcaaagccacagtggtcttttggggttgcaggggggytgctgggaccctgcatgtgccaggctcatgccccctgctgtgtgtgccctggagggagaagctcatgcacaccaccctgggttttgttttctaggtggct

SEQ ID NO: 72270 - DNA, 201 bp, Homo sapiens
ttggagtgcagtggcatgatctcggctcactgcaacctccgcctcctgggttcaagtgattctcctgcctcagcctcctgagtagctgggattataggctyttgccaccactcccagctaatttttatatttttagtagagatgaagttttgctgtgttgctcaggctggtcttgaactcctgagcttaggcaatccaccc

SEQ ID NO: 72271 - DNA, 201 bp, Homo sapiens
atagttctaaaacttttgtataaaaagtagcatgtaagttgtgtctatgaatgtgtatctgtgggtgtgttgtatctgttttataaaacttgaatagagcrtctataaaaacagttctcaagagtgtttgtactgataacagataaatacagatagggatataaacatcatggttaaataaatagcaaaaaagatcagctt

SEQ ID NO: 72272 - DNA, 201 bp, Homo sapiens
gctccggatgctggggatacggcactgggaaaaaattcctccctcatgatgatgaaggcaaacaataaataagatacataagtaaaaataggtagtcagcmggcaatacatactgaggggcagcagcataggaaaaattgagggcctggggtagaggtggggaagtcttcaccaagaaggtagcttctgagtagatctgaa

SEQ ID NO: 72273 - DNA, 201 bp, Homo sapiens
cccctctcaccctattctttcttctgccctggtcagattttacctccactgagaagctctccttactaccctattgtctgtgccctaaattcctgtgatcrttgctgcccatgccacgcattccatttattccatcagcgtgtattattgagtgtctgccgtgtgtcagacactgctccggatgctggggatacggcactg

SEQ ID NO: 72274 - DNA, 201 bp, Homo sapiens
tctatccatggtgttgcacatggccgtggtttgtttattgttgtgtgcattcagttttactaatattgcacaatatgtttatctgttctgctggtggctgrcattcaggttcttccaagcttgggtccattatgagtaatgccattataaacttttttttttttgagatggagtctcactcttgtcgcccaagctggagtg

SEQ ID NO: 72275 - DNA, 201 bp, Homo sapiens
ccttctagttgctgctcttacctcctctcgaggcagggtcatctgcctgccttagcctcccagagtgctgggattacaggcatgagccaccgagcctggcytaaaatgaccatcttgtcttttgagacagagtcttgctctgtcaccccagctggagtgcagtggcatgatcatggctcactgcagcctcaatctccctgg

SEQ ID NO: 72276 - DNA, 201 bp, Homo sapiens
  misc_feature (1)...(201): n = A,T,C or G, or insertion/deletion polymorphism (see Tables 1-2)
tacaggtaaggagatcatgaacgtacaactcaaaattttcacctagttaacacctaagaaatggatatgaccagcaacccagaagcctctcttctgtttcnttctagttgctgctcttacctcctctcgaggcagggtcatctgcctgccttagcctcccagagtgctgggattacaggcatgagccaccgagcctggcct

SEQ ID NO: 72277 - DNA, 201 bp, Homo sapiens
caatatatttaatctatgtaagatttttttctactttttgagtcaattttgattttttttttccaaaaattcatatctcaccaagtatggtggcttatgcytgtaatcccagcactttgggaggctcaggtgggaggaccacttgactacagtagttcaagaccagcctgggcaatatagtgagactccatctctgcaaaa

SEQ ID NO: 72278 - DNA, 201 bp, Homo sapiens
tttatttcaagaacacatgtaaatgaaaccatacactgtctgatattttgagattgagtttttttattcagcataattatcttgtgatccgtcaaagttgytttgatatattttatcatttttctttttatatttcatgggacattacttctattgttttatacgtttcacgtttgtttagttttatccatatattcacct

SEQ ID NO: 72279 - DNA, 201 bp, Homo sapiens
ccttttgttactgagaggtctaaaataacattttacaagtgtagttgaatatagcatcagtaaattggttatgaggaagactccttcataattgcttttawggattaaacatgtatctaaggacaacaccaaggaactactagaaataaccctcgagtcagtcttttccgttctgtttccacacccttagttttctattac

SEQ ID NO: 72280 - DNA, 201 bp, Homo sapiens
aaaactaagcagaggcttgctcaagaactcctgaggtcttggtggggttcggagattgggggaagaggagatggacaaaggctcccaagaggaagtagtaytgggtctgcagaatgacccagcaaagaatgagggcaagggattccaggcagtgggaattacttgtacataggccctgagacctgagagcagcgtgggttt

SEQ ID NO: 72281 - DNA, 201 bp, Homo sapiens
tcttactgtcctttgaatatgccttgacgttttctgcatgtgtgttcagttgttttccctgtttggacagattttcccctctcaccctattctttcttctrccctggtcagattttacctccactgagaagctctccttactaccctattgtctgtgccctaaattcctgtgatcgttgctgcccatgccacgcattccat

SEQ ID NO: 72282 - DNA, 201 bp, Homo sapiens
tgtataatgttccactttatggacatagaataacttatttgtccagtctcttataaatgggtcatcttttgttttgttttgttgtaaactgctgaaaactrtagtaatgtcctatgtgtctttgtgtgtatctatttttatttttttaatttttattttaggtttgggggtacgtgtgaaggtttgtcacacagataaata

SEQ ID NO: 72283 - DNA, 201 bp, Homo sapiens
ctgggttcacgccattctcctgcctcagcctcctgagtagctgggactacaggtgcccgctaccacggccggctaatttttttgtatttttagtagagacrgggtttcaccatgttagccaggatggtctcgatctcgtgactttgtgattcgtccaccttggcctccgaaagtaaagtgctgggattacaggtgtgagcc

SEQ ID NO: 72284 - DNA, 201 bp, Homo sapiens
agatacagaacagttccatcagaaggatggatcccttgtgctacccatcttatagtcacaaacacgttcctcactccctgacccctggcaaccactaatckgtttttcatctctgtaactttatttcaagaacacatgtaaatgaaaccatacactgtctgatattttgagattgagtttttttattcagcataattatct

SEQ ID NO: 72285 - DNA, 201 bp, Homo sapiens
tacctaaccaccatcaccatcgtcaagatacagaacagttccatcagaaggatggatcccttgtgctacccatcttatagtcacaaacacgttcctcactycctgacccctggcaaccactaatctgtttttcatctctgtaactttatttcaagaacacatgtaaatgaaaccatacactgtctgatattttgagattga

SEQ ID NO: 72286 - DNA, 201 bp, Homo sapiens
atgtgcacttttagttttttttgtgtatttagttctatgaaattttatcgtgtacatagattagatacctaaccaccatcaccatcgtcaagatacagaasagttccatcagaaggatggatcccttgtgctacccatcttatagtcacaaacacgttcctcactccctgacccctggcaaccactaatctgtttttcatc

SEQ ID NO: 72287 - DNA, 201 bp, Homo sapiens
gtttctcttaaaagttctctgataagtcattgccaccactacttccaaatagcatatgttaactttgagttaattttacataaacctgggttaatttacamaattttggcaccaacaacatggttaggcaaggcagcatggatgggtattggaatctgtcaatctgggttgctgtataccagctctgggactgggggcaag

SEQ ID NO: 72288 - DNA, 201 bp, Homo sapiens
gttttatgtgcacttttagttttttttgtgtatttagttctatgaaattttatcgtgtacatagattagatacctaaccaccatcaccatcgtcaagatayagaacagttccatcagaaggatggatcccttgtgctacccatcttatagtcacaaacacgttcctcactccctgacccctggcaaccactaatctgtttt

SEQ ID NO: 72289 - DNA, 201 bp, Homo sapiens
actaccttgttcatatttcaccagttttatgtgcacttttagttttttttgtgtatttagttctatgaaattttatcgtgtacatagattagatacctaaycaccatcaccatcgtcaagatacagaacagttccatcagaaggatggatcccttgtgctacccatcttatagtcacaaacacgttcctcactccctgacc

SEQ ID NO: 72290 - DNA, 201 bp, Homo sapiens
gtcttcactcagtttctcccaatggtaacatcttgcgtaactaccttgttcatatttcaccagttttatgtgcacttttagttttttttgtgtatttagtkctatgaaattttatcgtgtacatagattagatacctaaccaccatcaccatcgtcaagatacagaacagttccatcagaaggatggatcccttgtgctac

SEQ ID NO: 72291 - DNA, 201 bp, Homo sapiens
ataatagaaatcccatatagtcttcactcagtttctcccaatggtaacatcttgcgtaactaccttgttcatatttcaccagttttatgtgcacttttagktttttttgtgtatttagttctatgaaattttatcgtgtacatagattagatacctaaccaccatcaccatcgtcaagatacagaacagttccatcagaag

SEQ ID NO: 72292 - DNA, 201 bp, Homo sapiens
accccgtctctactaaaaatacaaaaattcgctaggtgtggtggcgggtacctgtaatcccacctacttgggaggctgaggcaggagaatccttgaacccrggaggcggagtttgcagtgagctgagatcgcaccactactgcactccagtctggtgacagagcaagcctctgtctcaaaaaaaaaaaaaaaaaaaaaaaa

SEQ ID NO: 72293 - DNA, 201 bp, Homo sapiens
gacataattgcagattcacaggcggttttaagaaataatagaaatcccatatagtcttcactcagtttctcccaatggtaacatcttgcgtaactaccttkttcatatttcaccagttttatgtgcacttttagttttttttgtgtatttagttctatgaaattttatcgtgtacatagattagatacctaaccaccatca

SEQ ID NO: 72294 - DNA, 201 bp, Homo sapiens
tgtttatattcttttagtaactgtcatgctaatttaaatgtgcatatttaagttatgaaagtctaaaatttatcctcctcctgggtgataggataacttargaatactttcatcgcattaaactcctcttgagttatgctactacagtatattttcaactttttattttgacataattgcagattcacaggcggttttaag

SEQ ID NO: 72295 - DNA, 201 bp, Homo sapiens
aatatgacttaaaaatagcatggaatgagattttaacaatttatccatctttaactggattacttagtccatttgcatgtatttgtattctgacatacttrgattctgtatagatggtgagtggtgtgtatgtacatgcatatgtgtttgtgtcattttgtcactttctatttatcctacttatgtttctttttttccttt

SEQ ID NO: 72296 - DNA, 201 bp, Homo sapiens
acctgtatcaggggaggctgagacccaccttgcaggggtcttgtgaagattaaatgcagtgctgtgtgaatggtgcctaccttcgtgcccggcctgtcaasaccaggcagtttacacaaaaacacttgatattgactatgaaacaagatccggaagagaacaaatataaatacagatggatcagctaaatgaaggactgtc

SEQ ID NO: 72297 - DNA, 201 bp, Homo sapiens
atcaaggttatttttattttaaccttataaaatgaactggggagtcttctttttttattctctcagtttgtgttagtggcagagttttttttgtttggttrgttggtttctctttttcttgtatgtttcatggaactttttggtgaaggcacttgggcctggaaatttctttatggcaagttttttcattactgattcaat

SEQ ID NO: 72298 - DNA, 201 bp, Homo sapiens
cttaagggctctattaggttgggtgctgtggctcctgcctgtaatcccagcactttgggaggccgaggcaggaagatcacttgaggccatgagtttgaaaycagcgtgggcaataaggtgaaattttttaagaattaaaaaaaaattaaaggcttaattagactcaggttaacactttagcaagaatgcttcagagctagt

SEQ ID NO: 72299 - DNA, 201 bp, Homo sapiens
gcggaggccggggagcagccgaccatggagccccagagtaagggaggcccgggctggagctgggaccggggcgggcgaccgggctggggctccccgggaamgagtgtgggcgccccgcgcgcgactccgcaggtttcaacgctcggacacggaaatacggtttgcgtctcctcgcgcttttctctcctggagaggggagaa

SEQ ID NO: 72300 - DNA, 201 bp, Homo sapiens
gcactttgggaggctgaggcaggcagatcacgaggtcaagagatcaagaccatcctggccaacatggtgaaaccccgtctctactaaaaatacaaaaattmgctaggtgtggtggcgggtacctgtaatcccacctacttgggaggctgaggcaggagaatccttgaacccgggaggcggagtttgcagtgagctgagatc

SEQ ID NO: 72301 - DNA, 201 bp, Homo sapiens
gttgggtgctgtggctcctgcctgtaatcccagcactttgggaggccgaggcaggaagatcacttgaggccatgagtttgaaaccagcgtgggcaataagstgaaattttttaagaattaaaaaaaaattaaaggcttaattagactcaggttaacactttagcaagaatgcttcagagctagtgttgtgacttcatgtta

SEQ ID NO: 72302 - DNA, 201 bp, Homo sapiens
accttttaaaatcattcaatatctttgtattttaaatatgacttaaaaatagcatggaatgagattttaacaatttatccatctttaactggattacttaktccatttgcatgtatttgtattctgacatacttggattctgtatagatggtgagtggtgtgtatgtacatgcatatgtgtttgtgtcattttgtcacttt

SEQ ID NO: 72303 - DNA, 201 bp, Homo sapiens
acgtattttaataccttttaaaatcattcaatatctttgtattttaaatatgacttaaaaatagcatggaatgagattttaacaatttatccatctttaaytggattacttagtccatttgcatgtatttgtattctgacatacttggattctgtatagatggtgagtggtgtgtatgtacatgcatatgtgtttgtgtca

SEQ ID NO: 72304 - DNA, 201 bp, Homo sapiens
ggctatattgccaaggctggtcttgagctcttggtctcaggtgatcctctcacctctgcttcctgagtcactgggattacagacatgtgccgccaagcctrgctcctctgatacgtattttaataccttttaaaatcattcaatatctttgtattttaaatatgacttaaaaatagcatggaatgagattttaacaattta

SEQ ID NO: 72305 - DNA, 201 bp, Homo sapiens
ctacctcagtctttagagtgatgtgtgccaccaccgccaaataattgtttttatttctttagagatagagtttggctatattgccaaggctggtcttgagytcttggtctcaggtgatcctctcacctctgcttcctgagtcactgggattacagacatgtgccgccaagcctggctcctctgatacgtattttaatacct

SEQ ID NO: 72306 - DNA, 201 bp, Homo sapiens
cctgctgccttgaactcctgggctcaaatgatcctcctacctcagtctttagagtgatgtgtgccaccaccgccaaataattgtttttatttctttagagwtagagtttggctatattgccaaggctggtcttgagctcttggtctcaggtgatcctctcacctctgcttcctgagtcactgggattacagacatgtgccg

SEQ ID NO: 72307 - DNA, 201 bp, Homo sapiens
tttgcactgtgtatctttcacgtgtatgtgtgtatttttttcccactgtgctgcccaggctatagtgcaggggctgttcacaggtgttcacaggtggctcmctgctgccttgaactcctgggctcaaatgatcctcctacctcagtctttagagtgatgtgtgccaccaccgccaaataattgtttttatttctttagaga

SEQ ID NO: 72308 - DNA, 201 bp, Homo sapiens
gttttccttcatttatgtatgctttcaacattacgtatgatatagctatagtaactttggttagactttgcactgtgtatctttcacgtgtatgtgtgtarttttttcccactgtgctgcccaggctatagtgcaggggctgttcacaggtgttcacaggtggctccctgctgccttgaactcctgggctcaaatgatcct

SEQ ID NO: 72309 - DNA, 201 bp, Homo sapiens
ttgagttgatttttgtataaggtaagagataaggatccagcttcattctcccacatgtgcataaccaattagcccagcaccatttgttgaaaagggtgtcytttccccactttgtttggtttgttgaagatcagttggttataagtgtttgggcttatttttgggttctctattctgtttcattgtttctatgtacctgtt

SEQ ID NO: 72310 - DNA, 201 bp, Homo sapiens
cttaacactcgtctatatggttaatttttgaacttgtccacattttcttgaagggaagtctgtttctgtagttaaatctcatgttctatatgtttgcattkagtatttttttcatagttttaaatcttcatcctccctaattatttttatactttatttactgagagatatattaaatatcctactagaagcatggatttg

SEQ ID NO: 72311 - DNA, 201 bp, Homo sapiens
acttttagaaagtttctaaaattgttaccagaaattgtgatctgtccactttcttagaaatttgttacttaacactcgtctatatggttaatttttgaacktgtccacattttcttgaagggaagtctgtttctgtagttaaatctcatgttctatatgtttgcattgagtatttttttcatagttttaaatcttcatcct

SEQ ID NO: 72312 - DNA, 201 bp, Homo sapiens
cccagcactttgagaggcaaaggtgggaggatcgcttgagcctgtaagggggaggctgtagtaagctgtgattgagcgactacactccagcctgggcaacrgaatgagaccctatctgaaaaccaaaaaacccacaagttttagcttggctgattctattgtgtgtttcttttgtatttcatttgtttgttatgtttttcc

SEQ ID NO: 72313 - DNA, 201 bp, Homo sapiens
gtagcgacgccggccctggctgagaggcgttaggagtccgggggttcgcccgcggaggccggggagcagccgaccatggagccccagagtaagggaggccygggctggagctgggaccggggcgggcgaccgggctggggctccccgggaacgagtgtgggcgccccgcgcgcgactccgcaggtttcaacgctcggacac

SEQ ID NO: 72314 - DNA, 201 bp, Homo sapiens
ttccttatgttttagagacaggcacagaggcagaaggctgagtcagtgggcttccatagtagagccgggcccacgtgccatgtgtggtagtgacagccacrcactccttgattggtttatgatgaattctgggcaggttttgcacctagtgaaagtctgtggttgaaaaagaaggttgtactttgctgaaagaagtcaagc

SEQ ID NO: 72315 - DNA, 201 bp, Homo sapiens
tccttgattggtttatgatgaattctgggcaggttttgcacctagtgaaagtctgtggttgaaaaagaaggttgtactttgctgaaagaagtcaagcatckgggccgggcacagtggcttatgcctgtaatcccagcactttgggaggccaaggcgggtggatcacttgaggtcaggagtttgagaccaacctggccaaca

SEQ ID NO: 72316 - DNA, 201 bp, Homo sapiens
ttagcagggcatggtggctcatacctgtaatcccagcactttgagaggcaaaggtgggaggatcgcttgagcctgtaagggggaggctgtagtaagctgtrattgagcgactacactccagcctgggcaacagaatgagaccctatctgaaaaccaaaaaacccacaagttttagcttggctgattctattgtgtgtttct

SEQ ID NO: 72317 - DNA, 201 bp, Homo sapiens
agttttaatcataaagtgatgctggattttgtcgaatgcattttctgcatctattgagatcatgtcatttttttttaaattttgtttgtgtggtgtaccasatttattgacttgcatatgttaaaccatccctgcatccctggtatgaaatccatttgatcatggtggattatctttttgatatgttgttggatttggtta

SEQ ID NO: 72318 - DNA, 201 bp, Homo sapiens
ctttctatctgtagtacagtcctcctgtgcaagattgttttttgactgctttttcttgacaaatcttgctaaaggtctgtgaattttataatgtatttttwaagaaccaggttttagcagggcatggtggctcatacctgtaatcccagcactttgagaggcaaaggtgggaggatcgcttgagcctgtaagggggaggct

SEQ ID NO: 72319 - DNA, 201 bp, Homo sapiens
ctcagtttgtgttagtggcagagttttttttgtttggttggttggtttctctttttcttgtatgtttcatggaactttttggtgaaggcacttgggcctgsaaatttctttatggcaagttttttcattactgattcaatatatttaatctatgtaagatttttttctactttttgagtcaattttgattttttttttcca

SEQ ID NO: 72320 - DNA, 201 bp, Homo sapiens
tctcagtttgtgttagtggcagagttttttttgtttggttggttggtttctctttttcttgtatgtttcatggaactttttggtgaaggcacttgggcctrgaaatttctttatggcaagttttttcattactgattcaatatatttaatctatgtaagatttttttctactttttgagtcaattttgattttttttttcc

SEQ ID NO: 72321 - DNA, 201 bp, Homo sapiens
aatgaactggggagtcttctttttttattctctcagtttgtgttagtggcagagttttttttgtttggttggttggtttctctttttcttgtatgtttcayggaactttttggtgaaggcacttgggcctggaaatttctttatggcaagttttttcattactgattcaatatatttaatctatgtaagatttttttctac

SEQ ID NO: 72322 - DNA, 201 bp, Homo sapiens
tgggttttgatatcaaggttatttttattttaaccttataaaatgaactggggagtcttctttttttattctctcagtttgtgttagtggcagagtttttkttgtttggttggttggtttctctttttcttgtatgtttcatggaactttttggtgaaggcacttgggcctggaaatttctttatggcaagttttttcatt

SEQ ID NO: 72323 - DNA, 201 bp, Homo sapiens
gatggcctataaatattttttcttgcacttgccttgttgggttttgatatcaaggttatttttattttaaccttataaaatgaactggggagtcttctttytttattctctcagtttgtgttagtggcagagttttttttgtttggttggttggtttctctttttcttgtatgtttcatggaactttttggtgaaggcact

SEQ ID NO: 72324 - DNA, 201 bp, Homo sapiens
ctggccagtacatcttaaaaatgatttctgatccacgttgaataatgatggcctataaatattttttcttgcacttgccttgttgggttttgatatcaagrttatttttattttaaccttataaaatgaactggggagtcttctttttttattctctcagtttgtgttagtggcagagttttttttgtttggttggttggt

SEQ ID NO: 72325 - DNA, 201 bp, Homo sapiens
gatactattttgtatgtattctgggattgaacaattgagaaactatatcgatgcttttggaaaacaggattctcactgcggaagaaagaatatgtaaatayggaaggaagaaaacaatatagtcatgttggatttgaactggagtgaatagtatgaatttatgattaaaaaaaaaatcctgactgtccactgaaaagtcta

SEQ ID NO: 72326 - DNA, 201 bp, Homo sapiens
cccaggctggagcacagtggcatgatcagggatcactgcattctcaaccggctaggctcaagtgatcctcccacctcagcctcccgaatagctgggtctayaggtgtgctgccatgcccagctaatttttgtattttttataaagacaggattttgccttgttgcccaggctggtctcaaactcctgagctcaggccatcc

SEQ ID NO: 72327 - DNA, 201 bp, Homo sapiens
catcctggccagcatcacaggtggtcagtacatctttctgttgttgttttgagacagggtctcactctgttgcccaggctggagcacagtggcatgatcarggatcactgcattctcaaccggctaggctcaagtgatcctcccacctcagcctcccgaatagctgggtctataggtgtgctgccatgcccagctaatttt

SEQ ID NO: 72328 - DNA, 201 bp, Homo sapiens
tcaatgatccaagaaatgacttcccagggaaagggcaaattaaatacgttcacaaccttgggctgttgagagtggttttggctcttggcttgcacattgamgtctttaattattttcttgctaaaccaacttcagtgttggaaagatagctcatgtataaaataacatggaaaacgtacatcacttcccatttgttttggg

SEQ ID NO: 72329 - DNA, 201 bp, Homo sapiens
aaaacagaactggtgaaacaaagaacaagctgctttctgttctggttttagtgtggagagagggagtccattttccattttccctggagttgctaccatayagctgcagaggaagcgctgtgcctgcaggccatgcaaagccacagtggtcttttggggttgcaggggggctgctgggaccctgcatgtgccaggctcatg

SEQ ID NO: 72330 - DNA, 201 bp, Homo sapiens
accaaaaccctggattacattcgcctgtctgttttgtttatctagagtgtagtctccttattagaagaaaggaaaaaaaagcagaggccaaagaagtcttktgtctgctgatgagagcaccactcatctgcgaaacgcacgtaaaacaaagtgaaccgtgactgttaaactagggatgggaaattctgcatcttggggggc

SEQ ID NO: 72331 - DNA, 201 bp, Homo sapiens
caccaccgccatccagataattcttcaggttttgacgtttcccaacctgtctgctggttacttttcagagtacttggatcattgctatttatattttgtcyagagtttcaaattgtgatcagtggaaatgacaggccgtagcatacatacgccatcctggccagcatcacaggtggtcagtacatctttctgttgttgttt

SEQ ID NO: 72332 - DNA, 201 bp, Homo sapiens
gaatatggactattttcactttttggtaaattataagtggattggaattcacaaagtgctttttgtctgagcataggttttcatttcacttgtgcaaatgmctaagggtgtaggattgctgagtcacatggtccgtgtacgtttgactttatcagaacctgccaaattgtcttccaaagtgctgtgccacttctgtttctt

SEQ ID NO: 72333 - DNA, 201 bp, Homo sapiens
ccttttatgaaattaggtgaggcccttgattagaatttgttttttaaaaggtttaatatgagtttatatctctaaatatcagtttctaattttttttaaargcctatgtttacaacaaatttgggagatacctatatgcactactaactagtgttcttttgtggtgctttagaaattctggcttacttgtatttttgctgg

SEQ ID NO: 72334 - DNA, 201 bp, Homo sapiens
cacataaacatttctgcttctctgtgacttatgggtagcattgatataaattgttaaaaataatgatcgtagatagataatgtatcagagtttgggctcasccgctgtagctgctgttgacccagaggaaccactgggatcctcacatctcagggcagcacatcgtttgcagcaatggttggttctgtacaaccttttatg

SEQ ID NO: 72335 - DNA, 201 bp, Homo sapiens
ttgtttttggcaggaggccacataaacatttctgcttctctgtgacttatgggtagcattgatataaattgttaaaaataatgatcgtagatagataatgwatcagagtttgggctcagccgctgtagctgctgttgacccagaggaaccactgggatcctcacatctcagggcagcacatcgtttgcagcaatggttggt

SEQ ID NO: 72336 - DNA, 201 bp, Homo sapiens
tgtcttctggaatactagaaataagtgcaagtgattgtttttggcaggaggccacataaacatttctgcttctctgtgacttatgggtagcattgatatamattgttaaaaataatgatcgtagatagataatgtatcagagtttgggctcagccgctgtagctgctgttgacccagaggaaccactgggatcctcacatc

SEQ ID NO: 72337 - DNA, 201 bp, Homo sapiens
tcactagattggttaagcaggaaatttacagagatttttttctttgctgtaaatgtttttctaaattgaaaaacttctaatactgtcttctggaatactakaaataagtgcaagtgattgtttttggcaggaggccacataaacatttctgcttctctgtgacttatgggtagcattgatataaattgttaaaaataatga

SEQ ID NO: 72338 - DNA, 201 bp, Homo sapiens
ttagaagtgactttggattaagtctttcataaggtggctaaatgaatttatatggctcatcagaattcactagattggttaagcaggaaatttacagagakttttttctttgctgtaaatgtttttctaaattgaaaaacttctaatactgtcttctggaatactagaaataagtgcaagtgattgtttttggcaggaggc

SEQ ID NO: 72339 - DNA, 201 bp, Homo sapiens
atacattagctcttctagaagttagaagtgactttggattaagtctttcataaggtggctaaatgaatttatatggctcatcagaattcactagattggtwaagcaggaaatttacagagatttttttctttgctgtaaatgtttttctaaattgaaaaacttctaatactgtcttctggaatactagaaataagtgcaag

SEQ ID NO: 72340 - DNA, 201 bp, Homo sapiens
aatacattagctcttctagaagttagaagtgactttggattaagtctttcataaggtggctaaatgaatttatatggctcatcagaattcactagattggwtaagcaggaaatttacagagatttttttctttgctgtaaatgtttttctaaattgaaaaacttctaatactgtcttctggaatactagaaataagtgcaa

SEQ ID NO: 72341 - DNA, 201 bp, Homo sapiens
  misc_feature (1)...(201): n = A,T,C or G, or insertion/deletion polymorphism (see Tables 1-2)
agatatagaccaaaccttgacatttctggcctttgagtctttcacaactgtgattataatacattagctcttctagaagttagaagtgactttggattaantctttcataaggtggctaaatgaatttatatggctcatcagaattcactagattggttaagcaggaaatttacagagatttttttctttgctgtaaatgt

SEQ ID NO: 72342 - DNA, 201 bp, Homo sapiens
gaagaaggatgacataggccgaaaaaattggcaatcatttggcctgtacatgttgcttttattttttttctggacttaagatatagaccaaaccttgacakttctggcctttgagtctttcacaactgtgattataatacattagctcttctagaagttagaagtgactttggattaagtctttcataaggtggctaaatg

SEQ ID NO: 72343 - DNA, 201 bp, Homo sapiens
gggtgaatatggttggttctgcagccttccatggtgggcttcaggtggcctctagcatcctcttaatagcacaccaaagccagggcaggggcttctggccstcctagcctgagtttacatggggttggagtaccatttggagcaattttaggaagggctgtttattagtgtgttctcacactgctaataaagacatacctg

SEQ ID NO: 72344 - DNA, 201 bp, Homo sapiens
aaatgtaatttcaggctatagtgaagaaggatgacataggccgaaaaaattggcaatcatttggcctgtacatgttgcttttattttttttctggacttargatatagaccaaaccttgacatttctggcctttgagtctttcacaactgtgattataatacattagctcttctagaagttagaagtgactttggattaag

SEQ ID NO: 72345 - DNA, 201 bp, Homo sapiens
tgagaactgtcaaacatgaaatgtaatttcaggctatagtgaagaaggatgacataggccgaaaaaattggcaatcatttggcctgtacatgttgcttttkttttttttctggacttaagatatagaccaaaccttgacatttctggcctttgagtctttcacaactgtgattataatacattagctcttctagaagttag

SEQ ID NO: 72346 - DNA, 201 bp, Homo sapiens
tgtctccttgctgagaactgtcaaacatgaaatgtaatttcaggctatagtgaagaaggatgacataggccgaaaaaattggcaatcatttggcctgtacrtgttgcttttattttttttctggacttaagatatagaccaaaccttgacatttctggcctttgagtctttcacaactgtgattataatacattagctctt

SEQ ID NO: 72347 - DNA, 201 bp, Homo sapiens
ttgaacttggacttgggagatgactcctgtctctcgtactctctgtggctctgctttctgttattttactcataagcttgttttgtctccttgctgagaaytgtcaaacatgaaatgtaatttcaggctatagtgaagaaggatgacataggccgaaaaaattggcaatcatttggcctgtacatgttgcttttatttttt

SEQ ID NO: 72348 - DNA, 201 bp, Homo sapiens
tactcatgctacaatcaatattaattccttgcagttcaaagacactgaggccctgtctaataatacagaggttgaacttggacttgggagatgactcctgyctctcgtactctctgtggctctgctttctgttattttactcataagcttgttttgtctccttgctgagaactgtcaaacatgaaatgtaatttcaggcta

SEQ ID NO: 72349 - DNA, 201 bp, Homo sapiens
actgtgacttttcatgatgagtagaagataggttttactcatgctacaatcaatattaattccttgcagttcaaagacactgaggccctgtctaataatayagaggttgaacttggacttgggagatgactcctgtctctcgtactctctgtggctctgctttctgttattttactcataagcttgttttgtctccttgct

SEQ ID NO: 72350 - DNA, 201 bp, Homo sapiens
tttaaacaaaacgactgtgacttttcatgatgagtagaagataggttttactcatgctacaatcaatattaattccttgcagttcaaagacactgaggccytgtctaataatacagaggttgaacttggacttgggagatgactcctgtctctcgtactctctgtggctctgctttctgttattttactcataagcttgtt

SEQ ID NO: 72351 - DNA, 201 bp, Homo sapiens
ttcctgattcctcgtttcaccaaacagtaggtgtgtaaccttcttatttgtttctgcctatagtaattctggagtctttaaacaaaacgactgtgactttycatgatgagtagaagataggttttactcatgctacaatcaatattaattccttgcagttcaaagacactgaggccctgtctaataatacagaggttgaac

SEQ ID NO: 72352 - DNA, 201 bp, Homo sapiens
gaacttaagcattcctcccacttcggtctcccaaagtgctgggattacaggtgcgagccatcgttcttggcctgcaagttatgacttcctttcagagtctwtctatctgtagtacagtcctcctgtgcaagattgttttttgactgctttttcttgacaaatcttgctaaaggtctgtgaattttataatgtatttttaaa

SEQ ID NO: 72353 - DNA, 201 bp, Homo sapiens
tttgttttatgacccagaatatgatctctcaccaccgccatccagataattcttcaggttttgacgtttcccaacctgtctgctggttacttttcagagtwcttggatcattgctatttatattttgtccagagtttcaaattgtgatcagtggaaatgacaggccgtagcatacatacgccatcctggccagcatcacag

SEQ ID NO: 72354 - DNA, 201 bp, Homo sapiens
tggggatgttctagaaatgttctagattcctagtttaattctgtcgtcagagaaaataattcactgaattttaattgtttaacttcagggtttgttttatsacccagaatatgatctctcaccaccgccatccagataattcttcaggttttgacgtttcccaacctgtctgctggttacttttcagagtacttggatcat

SEQ ID NO: 72355 - DNA, 201 bp, Homo sapiens
atcaacaaacacacagcacgtgtgtggccctggcacctgattcagatccttcccactaaggtcaacaatacccaggctcttggaggcagccactcctcatygattatttgcacatgagataaacctgtttgttttaccatattgaaggactaacagaagcacaaactgtaactcaagtgcttttccagtgaagagtgaaat

SEQ ID NO: 72356 - DNA, 201 bp, Homo sapiens
taatgcattaacttctgtagggttgcttgaatgtccttgcagtatggtagctactttcacccagggtgagcaaggtggaagctgccatgtgttttataatstagcctaggaaatttgaactatctttttgataacacaggtcagccacatttaatatgagagagaactacacaaggcctggatagcggaagtgaaaatcac

SEQ ID NO: 72357 - DNA, 201 bp, Homo sapiens
gagaaatgctttagctgggtggttctgtcttggtcaatatgttgattaggcctgcagtcatccgaaggcttgactgaggctagggcatccaatttcaagayggctcacttaacatggctagcaagtcaatgctgtctgttagcaggagacctctgtaatgtaatgcattaacttctgtagggttgcttgaatgtccttgca

SEQ ID NO: 72358 - DNA, 201 bp, Homo sapiens
gcatcactgcctgcagccaggaagccttctcaacctcaggggggctgtactgggtggtgaggatcaggtgtcctcctcctcctagctggggcaggctcttsgctctgtgggctggctgcagctcccttatgctattgtgttatatatttataatatccaaagcagattctcctaaggaggcagatcatgctaaacaaagaa

SEQ ID NO: 72359 - DNA, 201 bp, Homo sapiens
attttacttttgtaattgtattctcttgggaatgctcattcctgattcctcgtttcaccaaacagtaggtgtgtaaccttcttatttgtttctgcctatartaattctggagtctttaaacaaaacgactgtgacttttcatgatgagtagaagataggttttactcatgctacaatcaatattaattccttgcagttcaa

SEQ ID NO: 72360 - DNA, 201 bp, Homo sapiens
agatgattttacttttgtaattgtattctcttgggaatgctcattcctgattcctcgtttcaccaaacagtaggtgtgtaaccttcttatttgtttctgcytatagtaattctggagtctttaaacaaaacgactgtgacttttcatgatgagtagaagataggttttactcatgctacaatcaatattaattccttgcag

SEQ ID NO: 72361 - DNA, 201 bp, Homo sapiens
tagatgattttacttttgtaattgtattctcttgggaatgctcattcctgattcctcgtttcaccaaacagtaggtgtgtaaccttcttatttgtttctgmctatagtaattctggagtctttaaacaaaacgactgtgacttttcatgatgagtagaagataggttttactcatgctacaatcaatattaattccttgca

SEQ ID NO: 72362 - DNA, 201 bp, Homo sapiens
aagcagcccaaaaactctagatgattttacttttgtaattgtattctcttgggaatgctcattcctgattcctcgtttcaccaaacagtaggtgtgtaacyttcttatttgtttctgcctatagtaattctggagtctttaaacaaaacgactgtgacttttcatgatgagtagaagataggttttactcatgctacaatc

SEQ ID NO: 72363 - DNA, 201 bp, Homo sapiens
ttctaagcagcccaaaaactctagatgattttacttttgtaattgtattctcttgggaatgctcattcctgattcctcgtttcaccaaacagtaggtgtgkaaccttcttatttgtttctgcctatagtaattctggagtctttaaacaaaacgactgtgacttttcatgatgagtagaagataggttttactcatgctac

SEQ ID NO: 72364 - DNA, 201 bp, Homo sapiens
acagtcctgcagtgaacattcacatgcatgtgtgtttatggtagaatggtttatattcctctgggtatatacccagtaatgggattcctgggtcaaatagyagttctggttttagctctttgtggaattgccatactgctttccacaatcgttgaacaaatttatcccaccaacagtgtataaaggttccctttgtgacct

SEQ ID NO: 72365 - DNA, 201 bp, Homo sapiens
tggcacttctttctgggctttctaagcagcccaaaaactctagatgattttacttttgtaattgtattctcttgggaatgctcattcctgattcctcgttwcaccaaacagtaggtgtgtaaccttcttatttgtttctgcctatagtaattctggagtctttaaacaaaacgactgtgacttttcatgatgagtagaaga

SEQ ID NO: 72366 - DNA, 201 bp, Homo sapiens
agctgaccatgataccctcaagtgagtttttccactgaatttgattattttctcatttggcacttctttctgggctttctaagcagcccaaaaactctagrtgattttacttttgtaattgtattctcttgggaatgctcattcctgattcctcgtttcaccaaacagtaggtgtgtaaccttcttatttgtttctgccta

SEQ ID NO: 72367 - DNA, 201 bp, Homo sapiens
tcaaaggggtggaaacgcagctgaccatgataccctcaagtgagtttttccactgaatttgattattttctcatttggcacttctttctgggctttctaakcagcccaaaaactctagatgattttacttttgtaattgtattctcttgggaatgctcattcctgattcctcgtttcaccaaacagtaggtgtgtaacctt

SEQ ID NO: 72368 - DNA, 201 bp, Homo sapiens
accacacccggctaacttcttgtatttttagtagagatggggtttcaccgtgttagccaggatggtcttgatagaagtatcttattttttaaagtgaaggwtactttcagcctttgaacagtgtatggcacatgggaggcaggaagtgtctgttgaatgaaggattcctttgattgcagcataccaaggtttcttttattt

SEQ ID NO: 72369 - DNA, 201 bp, Homo sapiens
tgcatcaaaggggtggaaacgcagctgaccatgataccctcaagtgagtttttccactgaatttgattattttctcatttggcacttctttctgggctttytaagcagcccaaaaactctagatgattttacttttgtaattgtattctcttgggaatgctcattcctgattcctcgtttcaccaaacagtaggtgtgtaa

SEQ ID NO: 72370 - DNA, 201 bp, Homo sapiens
cctgcctcagcctcccaagtagctggaactataggcgcccaccaccacacccggctaacttcttgtatttttagtagagatggggtttcaccgtgttagcmaggatggtcttgatagaagtatcttattttttaaagtgaaggttactttcagcctttgaacagtgtatggcacatgggaggcaggaagtgtctgttgaat

SEQ ID NO: 72371 - DNA, 201 bp, Homo sapiens
gaagtgcatcaaaggggtggaaacgcagctgaccatgataccctcaagtgagtttttccactgaatttgattattttctcatttggcacttctttctgggytttctaagcagcccaaaaactctagatgattttacttttgtaattgtattctcttgggaatgctcattcctgattcctcgtttcaccaaacagtaggtgt

SEQ ID NO: 72372 - DNA, 201 bp, Homo sapiens
tcctgcctcagcctcccaagtagctggaactataggcgcccaccaccacacccggctaacttcttgtatttttagtagagatggggtttcaccgtgttagmcaggatggtcttgatagaagtatcttattttttaaagtgaaggttactttcagcctttgaacagtgtatggcacatgggaggcaggaagtgtctgttgaa

SEQ ID NO: 72373 - DNA, 201 bp, Homo sapiens
caatacagcaatagattttaaataacaatatcttaaatatcacttataaatttaaaaagtatttttccaaataactcataggttgagactaagccatcaaytccaagtttgaaaagaaaaatagcaatctgaaaagggaaaagaaaaaaagtatgaggagagtaggaaaaatgaaagaattaaaagtagacattgattaaa

SEQ ID NO: 72374 - DNA, 201 bp, Homo sapiens
catttttactggactattgtgggttctgagtgatcaaggtgacttatctagctacacttaagtttgtttcctttaggcttgtgaaaatcctagtttctaayggcacagacgtgaatctgaagaatggaagtggcaaggacaggtaggaggtgggatatgactgaaattgtgctgatgttctcagaattgtgttgctaggct

SEQ ID NO: 72375 - DNA, 201 bp, Homo sapiens
tttatattttaattaaatgccatttgaaaaaaacagaaatgcatcttcattacatgctaccatttaagaatacattaaaaatggccattcaaaggacagcraattattttggtagcccgatttgtttcatgtgctttcatttgattttaatgaataactcgtgtcaaaggtaaaagcccacatttctggaataaagaggtg

SEQ ID NO: 72376 - DNA, 201 bp, Homo sapiens
tggaattcaattttttttttttaagatgtagagagagggatattctggaaaactttctgctaggttgctaagttataattttcacagatacactctcattrtctgttccacacagagataagtattaatacgaatacctcattttcatttatattttaattaaatgccatttgaaaaaaacagaaatgcatcttcattaca

SEQ ID NO: 72377 - DNA, 201 bp, Homo sapiens
acagtggtgcaaactcattaacaagtaaacaactcacaccagtgctctgtgctcacagggctgggggcgttcttgggtatttttcttaagggaggctggargaagggaggaggcattcctttctcctagaggcaaaggccagttccttttgctgtgccccagacctttcctggttgttagaaactcttccaggccttttct

SEQ ID NO: 72378 - DNA, 201 bp, Homo sapiens
cctcgagtcagtcttttccgttctgtttccacacccttagttttctattacttttaggaatgacctttgttaactaagtcattaaaatccaataaacataractcttcagaccccacagctggatcatactcttggcagcaagcagaggaaggcaggggctaccactgttttacagaataatagtaagtcaatgatccaag

SEQ ID NO: 72379 - DNA, 201 bp, Homo sapiens
gcgttaggagtccgggggttcgcccgcggaggccggggagcagccgaccatggagccccagagtaagggaggcccgggctggagctgggaccggggcgggygaccgggctggggctccccgggaacgagtgtgggcgccccgcgcgcgactccgcaggtttcaacgctcggacacggaaatacggtttgcgtctcctcgcg

SEQ ID NO: 72380 - DNA, 201 bp, Homo sapiens
gtattctgacatacttggattctgtatagatggtgagtggtgtgtatgtacatgcatatgtgtttgtgtcattttgtcactttctatttatcctacttatrtttctttttttcctttcttgccttcttttcaattggtgggatattttttcttctctagtcattttaagttctagtctttgtttatattcttttagtaact

SEQ ID NO: 72381 - DNA, 201 bp, Homo sapiens
ctttgtggaatacacaggatttgaagtgcatcaaaggggtggaaacgcagctgaccatgataccctcaagtgagtttttccactgaatttgattattttcycatttggcacttctttctgggctttctaagcagcccaaaaactctagatgattttacttttgtaattgtattctcttgggaatgctcattcctgattcct

SEQ ID NO: 72382 - DNA, 201 bp, Homo sapiens
gtgaaccctagcctttagaaaggagcaagtctttgtggaatacacaggatttgaagtgcatcaaaggggtggaaacgcagctgaccatgataccctcaagkgagtttttccactgaatttgattattttctcatttggcacttctttctgggctttctaagcagcccaaaaactctagatgattttacttttgtaattgta

SEQ ID NO: 72383 - DNA, 201 bp, Homo sapiens
catgatcttggctcactgcaaactccgcctcctgggttcacgccattctcctgcctcagcctcctgagtagctgggactacaggtgcccgctaccacggcyggctaatttttttgtatttttagtagagacagggtttcaccatgttagccaggatggtctcgatctcgtgactttgtgattcgtccaccttggcctccga

SEQ ID NO: 72384 - DNA, 201 bp, Homo sapiens
ttgaacgtgaaccctagcctttagaaaggagcaagtctttgtggaatacacaggatttgaagtgcatcaaaggggtggaaacgcagctgaccatgataccytcaagtgagtttttccactgaatttgattattttctcatttggcacttctttctgggctttctaagcagcccaaaaactctagatgattttacttttgta

SEQ ID NO: 72385 - DNA, 201 bp, Homo sapiens
gttgaacgtgaaccctagcctttagaaaggagcaagtctttgtggaatacacaggatttgaagtgcatcaaaggggtggaaacgcagctgaccatgatacyctcaagtgagtttttccactgaatttgattattttctcatttggcacttctttctgggctttctaagcagcccaaaaactctagatgattttacttttgt

SEQ ID NO: 72386 - DNA, 201 bp, Homo sapiens
attctgttgaacgtgaaccctagcctttagaaaggagcaagtctttgtggaatacacaggatttgaagtgcatcaaaggggtggaaacgcagctgaccatsataccctcaagtgagtttttccactgaatttgattattttctcatttggcacttctttctgggctttctaagcagcccaaaaactctagatgattttact

SEQ ID NO: 72387 - DNA, 201 bp, Homo sapiens
gaatgagggaaagactcatttctttgaataaggcagaatactaaagactagccagccctgaggctcatggtggttgctgttattctgttgaacgtgaaccmtagcctttagaaaggagcaagtctttgtggaatacacaggatttgaagtgcatcaaaggggtggaaacgcagctgaccatgataccctcaagtgagtttt

SEQ ID NO: 72388 - DNA, 201 bp, Homo sapiens
ttggggatttaactttttattttattcaaaggctctggtcaggataaggatgggaggaaaaagggccatggaggaaccgtttcttttctatctcccaaacygtaccatatgatggcttagaaattcaactattgtaatcataaagttacacaacatgcaggagagaatgtaaatcatgtgttgaggaagagaggtagccat

SEQ ID NO: 72389 - DNA, 201 bp, Homo sapiens
tttatgaatgagggaaagactcatttctttgaataaggcagaatactaaagactagccagccctgaggctcatggtggttgctgttattctgttgaacgtsaaccctagcctttagaaaggagcaagtctttgtggaatacacaggatttgaagtgcatcaaaggggtggaaacgcagctgaccatgataccctcaagtga

SEQ ID NO: 72390 - DNA, 201 bp, Homo sapiens
ccacaaagaaattggaattttcagtaaaatgagtcattttacccacctaagccctgtgagaaccaccggctttgactctgcagtagctgtactgagcatgyttatctcttttctctgcttttcccaagccgtgttaaggttgatgttcccaataagtttggctttaccgctctgatggttgctgcccagaaaggatacacc

SEQ ID NO: 72391 - DNA, 201 bp, Homo sapiens
atggacctgggagatctttatgaatgagggaaagactcatttctttgaataaggcagaatactaaagactagccagccctgaggctcatggtggttgctgytattctgttgaacgtgaaccctagcctttagaaaggagcaagtctttgtggaatacacaggatttgaagtgcatcaaaggggtggaaacgcagctgacca

SEQ ID NO: 72392 - DNA, 201 bp, Homo sapiens
ccgaaagggctgctctctacccagtaggtgagatgggaggcaaggataaagcttgagtctccaccaatacagactcatgttcggtagagctgagagtcagyagtgaagacactgtcctcagctatcttaaagagctgtgttcactggagagtgctttatccgatggcctcatggctttgagccgaagcatgtatattttaa

SEQ ID NO: 72393 - DNA, 201 bp, Homo sapiens
tcctttttttgtaatggacctgggagatctttatgaatgagggaaagactcatttctttgaataaggcagaatactaaagactagccagccctgaggctcmtggtggttgctgttattctgttgaacgtgaaccctagcctttagaaaggagcaagtctttgtggaatacacaggatttgaagtgcatcaaaggggtggaa

SEQ ID NO: 72394 - DNA, 201 bp, Homo sapiens
attttgttttcctaaaaattcccatggctttgaaactgcctccaaaatggatctcaggtgactggtgtgagttaataaaccacagttaataaagatgctcrtgaagccccatgtaaatgttatattttgtgattgtgtaatagaaattgtaaaaggaattacaaggctgggtgtcatattttcttcccagaaataatttct

SEQ ID NO: 72395 - DNA, 201 bp, Homo sapiens
ctgctgctcctttttttgtaatggacctgggagatctttatgaatgagggaaagactcatttctttgaataaggcagaatactaaagactagccagccctsaggctcatggtggttgctgttattctgttgaacgtgaaccctagcctttagaaaggagcaagtctttgtggaatacacaggatttgaagtgcatcaaagg

SEQ ID NO: 72396 - DNA, 201 bp, Homo sapiens
tttagaccagggattataaactcaaactcttgccgtttgcggatgaggggctgggcgtacagttggagtatgtaagaagtggtggggctgtatccactgaygatggtagctgctgtactgtcacccccaacaacaggttgtgtgctgggtacttacgatgtgtcaggtgctattcgaagtgcttcattggtgttatttcat

SEQ ID NO: 72397 - DNA, 201 bp, Homo sapiens
acttggcatgtacattacttaggtttgttgaatgaataaatgagacctttgaggtttttttagaccagggattataaactcaaactcttgccgtttgcggrtgaggggctgggcgtacagttggagtatgtaagaagtggtggggctgtatccactgacgatggtagctgctgtactgtcacccccaacaacaggttgtgt

SEQ ID NO: 72398 - DNA, 201 bp, Homo sapiens
tgtaagtgagcatgggaactaatggttagctcttttcatgctaaccccctagagcctagcacaggacttggcatgtacattacttaggtttgttgaatgartaaatgagacctttgaggtttttttagaccagggattataaactcaaactcttgccgtttgcggatgaggggctgggcgtacagttggagtatgtaagaa

SEQ ID NO: 72399 - DNA, 201 bp, Homo sapiens
tgccaggtgctgtgctttggcacatgggtgaaacactgagcaaaatgccaggccctggcttcaggggctgtggtcacaacacacacagaaccagggcttgrgcactgtagatgacatcgacagacagctgccaaacaccttctgggggaggccttgaagaaaaccccaactaacttctcaaatcagaaggcctatcttcta

SEQ ID NO: 72400 - DNA, 201 bp, Homo sapiens
catcccagagagattttctaccataaggagcaggaagagggaggccagctgatctttctgggccggaccataagagggagggtgggtgagccccaggaggyggcgtagggtgcagtgggggaggatggggtaagagggagggtgggtgagccccaggaggcagtgtagggtgcagtgggggaggatggggtaggagtggat

SEQ ID NO: 72401 - DNA, 201 bp, Homo sapiens
ccttattaatctagcccagggttctcaactttggtactactgatatttggggactggatggttccttgtggtgtcctgtgcacttatggattcttagcagsttccttggcctctatcctctagatgccagtgctccatccccttcgttgtggcaatcaaaaatgtcaccagacattgccaaatgtcctctggggtataaaa

SEQ ID NO: 72402 - DNA, 201 bp, Homo sapiens
ccaaatgacttgtttttatgtttgagtggcaggtgaagtttcagattaggaaaaagtggggcctgttaatgggataacagagacttttataaacataccasttttcttctcctggttagcaacagaaggggaaacagtctatgggtttagttcatccatctaaagtatagatgagacgcatcatgattttaagtccttatt

SEQ ID NO: 72403 - DNA, 201 bp, Homo sapiens
tgcagaggaagcgctgtgcctgcaggccatgcaaagccacagtggtcttttggggttgcaggggggctgctgggaccctgcatgtgccaggctcatgcccyctgctgtgtgtgccctggagggagaagctcatgcacaccaccctgggttttgttttctaggtggctgtgttaaataatcatgaagagttagttcagttac

SEQ ID NO: 72404 - DNA, 201 bp, Homo sapiens
  misc_feature (1)...(201): n = A,T,C or G, or insertion/deletion polymorphism (see Tables 1-2)
gttgacttagcagccttcacaaaactggttggaatttccactgggattaaattgataggtcatttttgggagacctttgcaatattgaactttccaatccntgaacttatctgcccatgtattatgtttgtttttggtagattacaaaattatatgatcactccaaaaattaccttgccctttatagtaaaaccttccatt

SEQ ID NO: 72405 - DNA, 201 bp, Homo sapiens
  misc_feature (1)...(201): n = A,T,C or G, or insertion/deletion polymorphism (see Tables 1-2)
atcttgtctattcttggccattttagagttgacttagcagccttcacaaaactggttggaatttccactgggattaaattgataggtcatttttgggaganctttgcaatattgaactttccaatccgtgaacttatctgcccatgtattatgtttgtttttggtagattacaaaattatatgatcactccaaaaattacc

SEQ ID NO: 72406 - DNA, 201 bp, Homo sapiens
cataaacatttctgcttctctgtgacttatgggtagcattgatataaattgttaaaaataatgatcgtagatagataatgtatcagagtttgggctcagcbgctgtagctgctgttgacccagaggaaccactgggatcctcacatctcagggcagcacatcgtttgcagcaatggttggttctgtacaaccttttatgaa

SEQ ID NO: 72407 - DNA, 201 bp, Homo sapiens
tgattataatacattagctcttctagaagttagaagtgactttggattaagtctttcataaggtggctaaatgaatttatatggctcatcagaattcactwgattggttaagcaggaaatttacagagatttttttctttgctgtaaatgtttttctaaattgaaaaacttctaatactgtcttctggaatactagaaata

SEQ ID NO: 72408 - DNA, 201 bp, Homo sapiens
gtaatttcaggctatagtgaagaaggatgacataggccgaaaaaattggcaatcatttggcctgtacatgttgcttttattttttttctggacttaagatrtagaccaaaccttgacatttctggcctttgagtctttcacaactgtgattataatacattagctcttctagaagttagaagtgactttggattaagtctt

SEQ ID NO: 72409 - DNA, 201 bp, Homo sapiens
tgctacaatcaatattaattccttgcagttcaaagacactgaggccctgtctaataatacagaggttgaacttggacttgggagatgactcctgtctctcrtactctctgtggctctgctttctgttattttactcataagcttgttttgtctccttgctgagaactgtcaaacatgaaatgtaatttcaggctatagtga

SEQ ID NO: 72410 - DNA, 201 bp, Homo sapiens
caaacagtaggtgtgtaaccttcttatttgtttctgcctatagtaattctggagtctttaaacaaaacgactgtgacttttcatgatgagtagaagatagrttttactcatgctacaatcaatattaattccttgcagttcaaagacactgaggccctgtctaataatacagaggttgaacttggacttgggagatgactc

SEQ ID NO: 72411 - DNA, 201 bp, Homo sapiens
gctgaaaggcgttctgcctagcaaggatgcaggtgatttacacacgatctactcttgaagcttaaaccagtacttctatgatacattttttggggggggggcggtggtgggggtaaagggaggaaacaaccaggatgaggattgaatatatttgaaaggagattcaaagtgatgtttattgagcacttcactttggaaaag

SEQ ID NO: 72412 - DNA, 201 bp, Homo sapiens
agatggctgggactggttcagtctacatataattgaaaggtaaatcactaggaaagggaaggagtctctgggtttcaagatgaaatagaagtcatgagaaytctataaatttaaattcaagttcactgaagagagctaggagtcagctactgtttgctacagataatattcagtaaggagctaactgctaatgcattggcc

SEQ ID NO: 72413 - DNA, 201 bp, Homo sapiens
aagtgctgggattacaggtgtgagccactgtgcctggccccatcttatttttaaatgaagttttaataagatctcagttgtatgcttcatctcaagtgattattcagctccaaaacaaatcaagttccttccaagtacaaaagaatctatgttctaaggcagtggaaggaagcagggttggggaggatatatcatgttcaa

SEQ ID NO: 72414 - DNA, 201 bp, Homo sapiens
aactaaagatggctgggactggttcagtctacatataattgaaaggtaaatcactaggaaagggaaggagtctctgggtttcaagatgaaatagaagtcaygagaattctataaatttaaattcaagttcactgaagagagctaggagtcagctactgtttgctacagataatattcagtaaggagctaactgctaatgca

SEQ ID NO: 72415 - DNA, 201 bp, Homo sapiens
tccctctgtctcccttaagacctttgctgctgtggtgcccagcaggaaatacatacacacacacacacacacacacacacacacacacacacacacacacactgttcttacgtgcctgatatggtggactcattaaaggctggggtggcagctctgggggagttaatttgctttatccccatagggagaaagctcagtgta

SEQ ID NO: 72416 - DNA, 201 bp, Homo sapiens
ggttcaagctttcagtgaattatgatcatgccactgtactccaacctgggcgacagagtgagaccctgtcagaaaaaagaaaaaaaaagggtagtttggtkgttgccagaggctggggtagagaggaatgagggcttattgcttactgggtacagagtttcacttcgggatgatgaaaatgttctggagatggatggtggt

SEQ ID NO: 72417 - DNA, 201 bp, Homo sapiens
ctccctctgtctcccttaagacctttgctgctgtggtgcccagcaggaaatacatacacacacacacacacacacacacacacacacacacacacacacacactgttcttacgtgcctgatatggtggactcattaaaggctggggtggcagctctgggggagttaatttgctttatccccatagggagaaagctcagtgt

SEQ ID NO: 72418 - DNA, 201 bp, Homo sapiens
ttttctcttgttaatctgtcttttggtacaagagccccagccaagaaattagaagggtggaggaaaaatatttttcctcccttacatatgattccacttayatgagatacctagatcagtaaaattcacagaaacaaagtagaatggtagtcaggctcagtggctcattcctgtaatcccaacatcttggaaggataaggc

SEQ ID NO: 72419 - DNA, 201 bp, Homo sapiens
tctccctctgtctcccttaagacctttgctgctgtggtgcccagcaggaaatacatacacacacacacacacacacacacacacacacacacacacacacacactgttcttacgtgcctgatatggtggactcattaaaggctggggtggcagctctgggggagttaatttgctttatccccatagggagaaagctcagtg

SEQ ID NO: 72420 - DNA, 201 bp, Homo sapiens
aaaacttatattaagtaaatgtgtatgcttttctcttgttaatctgtcttttggtacaagagccccagccaagaaattagaagggtggaggaaaaatattkttcctcccttacatatgattccacttatatgagatacctagatcagtaaaattcacagaaacaaagtagaatggtagtcaggctcagtggctcattcctg

SEQ ID NO: 72421 - DNA, 201 bp, Homo sapiens
gtctccctctgtctcccttaagacctttgctgctgtggtgcccagcaggaaatacatacacacacacacacacacacacacacacacacacacacacacacacactgttcttacgtgcctgatatggtggactcattaaaggctggggtggcagctctgggggagttaatttgctttatccccatagggagaaagctcagt

SEQ ID NO: 72422 - DNA, 201 bp, Homo sapiens
tctttatttccttacaaaggttcctagttagatcaagttacttccagaaaagtcaatttcttctgtgtcatataaaacttatattaagtaaatgtgtatgmttttctcttgttaatctgtcttttggtacaagagccccagccaagaaattagaagggtggaggaaaaatatttttcctcccttacatatgattccactta

SEQ ID NO: 72423 - DNA, 201 bp, Homo sapiens
tgtctccctctgtctcccttaagacctttgctgctgtggtgcccagcaggaaatacatacacacacacacacacacacacacacacacacacacacacacmcacactgttcttacgtgcctgatatggtggactcattaaaggctggggtggcagctctgggggagttaatttgctttatccccatagggagaaagctcag

SEQ ID NO: 72424 - DNA, 201 bp, Homo sapiens
gctttatatgttgttataggtgatttatccaaatgacttgtttttatgtttgagtggcaggtgaagtttcagattaggaaaaagtggggcctgttaatggrataacagagacttttataaacataccacttttcttctcctggttagcaacagaaggggaaacagtctatgggtttagttcatccatctaaagtatagatg

SEQ ID NO: 72425 - DNA, 201 bp, Homo sapiens
tgaatcatgaataaaagccaattaaatctataaatttgttgtagtcctctgataatataaaacctaatttgtaatttagtcttttgacgaacctaatatamaaagacataggtttaactgtttcttcaggtctttatttccttacaaaggttcctagttagatcaagttacttccagaaaagtcaatttcttctgtgtcat

SEQ ID NO: 72426 - DNA, 201 bp, Homo sapiens
ctctcctgtggaatggtaccttgttgttgttctgtgagttgtttgtctccctctgtctcccttaagacctttgctgctgtggtgcccagcaggaaatacayacacacacacacacacacacacacacacacacacacacacacacacactgttcttacgtgcctgatatggtggactcattaaaggctggggtggcagctc

SEQ ID NO: 72427 - DNA, 201 bp, Homo sapiens
ccagtgggagctctcattctgttttgtagagtggaaggtgcccagattcatgaatcatgaataaaagccaattaaatctataaatttgttgtagtcctctsataatataaaacctaatttgtaatttagtcttttgacgaacctaatatataaagacataggtttaactgtttcttcaggtctttatttccttacaaaggt

SEQ ID NO: 72428 - DNA, 201 bp, Homo sapiens
aacatgagcgatggcttcctcaagaccactctgccctgctctgcccttctcctcggtgcccctgctcacctggccctgactggtgagtccatccggctcasgtgagcatgggctaacatcctcaccatgggcagaatcagtttgataattgtaattgcaacactcagggtaaaacactagaaaaacccgcagagcaatggc

SEQ ID NO: 72429 - DNA, 201 bp, Homo sapiens
gtggtagccagcacaggcccagtgatgctgctggaagcatcagcgtcacagtctcagtggcttatggcagcagtgattccctcctacacaccatgcccacygtgggtcggccagggctccatcctgcattgtcctcctgccacagcccaggccatgcggcagcctctgcgtgaacattgtcagtcactgtagcaggggaga

SEQ ID NO: 72430 - DNA, 201 bp, Homo sapiens
tgatgttaaccaatcaggtttttctattctgtttccttgttgctacctcataaaacctgtggttctgctattgcccagtgggagctctcattctgttttgyagagtggaaggtgcccagattcatgaatcatgaataaaagccaattaaatctataaatttgttgtagtcctctgataatataaaacctaatttgtaattt

SEQ ID NO: 72431 - DNA, 201 bp, Homo sapiens
cgatgtctgagacagagtggcccaccctcctggtttgtatacctctgcttgcctctctcctgtggaatggtaccttgttgttgttctgtgagttgtttgtytccctctgtctcccttaagacctttgctgctgtggtgcccagcaggaaatacatacacacacacacacacacacacacacacacacacacacacacacac

SEQ ID NO: 72432 - DNA, 201 bp, Homo sapiens
cttagagaacatgagcgatggcttcctcaagaccactctgccctgctctgcccttctcctcggtgcccctgctcacctggccctgactggtgagtccatcyggctcaggtgagcatgggctaacatcctcaccatgggcagaatcagtttgataattgtaattgcaacactcagggtaaaacactagaaaaacccgcagag

SEQ ID NO: 72433 - DNA, 201 bp, Homo sapiens
tcccctctgctttaactattacaaaaaagtaaccgaagtagcttgatgttaaccaatcaggtttttctattctgtttccttgttgctacctcataaaacckgtggttctgctattgcccagtgggagctctcattctgttttgtagagtggaaggtgcccagattcatgaatcatgaataaaagccaattaaatctataaa

SEQ ID NO: 72434 - DNA, 201 bp, Homo sapiens
agggatttagaactagaaataccatttgacccagccatcccattactgggtatatacccaaatgactataaatcatgctgctataaagacacatgcacacrtatgtttattgcggcattattcacaattgcaaagacttggaaccaacccaaatgtccaacaatgatagactggattaagaaaatgtggcacatatacacc

SEQ ID NO: 72435 - DNA, 201 bp, Homo sapiens
aatatctgcaggtacatctgcaactaaatgaccctcttagagaacatgagcgatggcttcctcaagaccactctgccctgctctgcccttctcctcggtgyccctgctcacctggccctgactggtgagtccatccggctcaggtgagcatgggctaacatcctcaccatgggcagaatcagtttgataattgtaattgca

SEQ ID NO: 72436 - DNA, 201 bp, Homo sapiens
atgcttctgtgtggtggtaatttgcattcagtttgagagtgttttaatgagtcacagaggcatgcactttgtttgaataaagaatgaacagcctttttttyccccccaggtaaagtacacagattcttgcttaaatgaggcttacaattttaatcagttgggcccttataaagaaagaaaaacagctgctacttgttaatt

SEQ ID NO: 72437 - DNA, 201 bp, Homo sapiens
tggttaggcaaggcagcatggatgggtattggaatctgtcaatctgggttgctgtataccagctctgggactgggggcaagttgtagcagccctgagcctsctgcttcacctgtatcaggggaggctgagacccaccttgcaggggtcttgtgaagattaaatgcagtgctgtgtgaatggtgcctaccttcgtgcccggc

SEQ ID NO: 72438 - DNA, 201 bp, Homo sapiens
gttctcacactgctaataaagacatacctgaggctgggtaatttattataaaggaaagaagtttaatggactcacagttccacatggctggggaggcctcrcaaccatggtggaaggcaaagaaggagtaaaggcatgtcttccacggcggcaggcaagagagagcatgtgcaggggaatttccctttataaaaccatcag

SEQ ID NO: 72439 - DNA, 201 bp, Homo sapiens
gcagcccaaaaactctagatgattttacttttgtaattgtattctcttgggaatgctcattcctgattcctcgtttcaccaaacagtaggtgtgtaacctkcttatttgtttctgcctatagtaattctggagtctttaaacaaaacgactgtgacttttcatgatgagtagaagataggttttactcatgctacaatcaa

SEQ ID NO: 72440 - DNA, 201 bp, Homo sapiens
gctaccatacagctgcagaggaagcgctgtgcctgcaggccatgcaaagccacagtggtcttttggggttgcaggggggctgctgggaccctgcatgtgcyaggctcatgccccctgctgtgtgtgccctggagggagaagctcatgcacaccaccctgggttttgttttctaggtggctgtgttaaataatcatgaagag

SEQ ID NO: 72441 - DNA, 201 bp, Homo sapiens
agcagatagatccccaaacagaccagtttttcctgaaaacatgagattccagtctacttgaatcagcggaagaaggaagtcccctctgctttaactattamaaaaaagtaaccgaagtagcttgatgttaaccaatcaggtttttctattctgtttccttgttgctacctcataaaacctgtggttctgctattgcccagt

SEQ ID NO: 72442 - DNA, 201 bp, Homo sapiens
cgtgtcaaaggtaaaagcccacatttctggaataaagaggtggttttctggtttaatggtgcctggttttaaaaccagctggcttctgaaggtgcagaagmaactgttgaaagatacatcttggatgctgtgttactcatttttactggactattgtgggttctgagtgatcaaggtgacttatctagctacacttaagtt

SEQ ID NO: 72443 - DNA, 201 bp, Homo sapiens
atccttctctctgaagataacgctgaatcgaatctgaatgatacgtcctgctgttcctcccagtttactacgcttagctcctacccctttttgtcctctcrcaattttctgcttctctccacttttcatcaaactgttaaaaattatgggaggccattcttttgggctgagctcctgcactagccctcaacagatcagacc

SEQ ID NO: 72444 - DNA, 201 bp, Homo sapiens
gcaggtcacaaggcccttgggtgagaggtgccctctctgtccctggaggaaggaacatccttctctctgaagataacgctgaatcgaatctgaatgatacktcctgctgttcctcccagtttactacgcttagctcctacccctttttgtcctctcacaattttctgcttctctccacttttcatcaaactgttaaaaatt

SEQ ID NO: 72445 - DNA, 201 bp, Homo sapiens
gtagagacagggttttgccatgttgcccaggctggtctcaaactcctgaacttaagcattcctcccacttcggtctcccaaagtgctgggattacaggtgygagccatcgttcttggcctgcaagttatgacttcctttcagagtctttctatctgtagtacagtcctcctgtgcaagattgttttttgactgctttttct

SEQ ID NO: 72446 - DNA, 201 bp, Homo sapiens
gacaggaagaacactctgaccttcccaccctcttctctgacgcaggtcacaaggcccttgggtgagaggtgccctctctgtccctggaggaaggaacatcyttctctctgaagataacgctgaatcgaatctgaatgatacgtcctgctgttcctcccagtttactacgcttagctcctacccctttttgtcctctcacaa

SEQ ID NO: 72447 - DNA, 201 bp, Homo sapiens
aataaaccagtcaccaaagaacaagtattttatgtgatcagcttcttgataatctccaaaatagccaccttagcatattgaatgtttgaagctgaaggaawctcagaaatgacaggaagaacactctgaccttcccaccctcttctctgacgcaggtcacaaggcccttgggtgagaggtgccctctctgtccctggagga

SEQ ID NO: 72448 - DNA, 201 bp, Homo sapiens
gatcagggaccccatctgccttctctgtgggcgtaggataaattcttttgattatgtctatttgatataaaaaaatctgtagttaaaatataccatttgcrttatccataatagccaaagggtggaagcaagccaagtgtctatctgcaaatgaataaacaaaatatggtatatatatacactatatgcagtagaatacta

SEQ ID NO: 72449 - DNA, 201 bp, Homo sapiens
cataggtttatgaagaaggcattttaaaaagagaacccctgtaatcgatcagggaccccatctgccttctctgtgggcgtaggataaattcttttgattaygtctatttgatataaaaaaatctgtagttaaaatataccatttgcattatccataatagccaaagggtggaagcaagccaagtgtctatctgcaaatgaa

SEQ ID NO: 72450 - DNA, 201 bp, Homo sapiens
caaactgcaggttgctgtctatattaacttgacagtttgtaataactgcttgagattagcagtttgtctgtttcttcagtttagttaattgtcatatgtarctcctctgtgtaatatgagaaagtaatgagaattttttttttttcttttcagacggagtcttgctctgtcaccaggctggagtgcagtagtggtgcaatc

SEQ ID NO: 72451 - DNA, 201 bp, Homo sapiens
tgtgatctaaacaatgtgtagtgtttccactgaagcacagatgttttccctgtgatttgtagtgattggcattttcaaactgcaggttgctgtctatattmacttgacagtttgtaataactgcttgagattagcagtttgtctgtttcttcagtttagttaattgtcatatgtagctcctctgtgtaatatgagaaagta

SEQ ID NO: 72452 - DNA, 201 bp, Homo sapiens
aaggagtgtgatctaaacaatgtgtagtgtttccactgaagcacagatgttttccctgtgatttgtagtgattggcattttcaaactgcaggttgctgtcyatattaacttgacagtttgtaataactgcttgagattagcagtttgtctgtttcttcagtttagttaattgtcatatgtagctcctctgtgtaatatgag

SEQ ID NO: 72453 - DNA, 201 bp, Homo sapiens
gcatggtactggtaccaaaagagagatatagatcaatggaacagaacagagccctcagaaataacgccgcatatctacaactatctgatctttgacaaacstgagaaaaacaagcaatggggaaaggattccctatttaataaatggtgctgggaaaactggctagccatatgtagaaagctgaaactggatcccttcctt

SEQ ID NO: 72454 - DNA, 201 bp, Homo sapiens
aagggatgtgaaggacctcttcaaggagaactacaaaccactgctcaaggaaataaaagaggatacaaacaaatggaagaacattccacgctcatgggtargaagaatcaatatcgtgaaaatggccatactgcccaaggtaatttacagattcaatgccatccccatcaagctaccaatgactttcttcacagaattgga

SEQ ID NO: 72455 - DNA, 201 bp, Homo sapiens
aatccaacttacaagggatgtgaaggacctcttcaaggagaactacaaaccactgctcaaggaaataaaagaggatacaaacaaatggaagaacattccaygctcatgggtaagaagaatcaatatcgtgaaaatggccatactgcccaaggtaatttacagattcaatgccatccccatcaagctaccaatgactttctt

SEQ ID NO: 72456 - DNA, 201 bp, Homo sapiens
caatatcatactgaatgggcaaaaactggaagcattccctttgaaaactggcacaacacagggatgccctctctcaccactcctattcaacatagtgttgkaagttctggccagggcaattaggcaggagaaggaaataaagggtattcaattaggaaaagaggaagtcaaattgtccctgtttgcagacaacatgattgt

SEQ ID NO: 72457 - DNA, 201 bp, Homo sapiens
ctctttagctgcgttttcccctgcaggatgtaggctttatttctgtctagctcatttgtggatccccagctcctacacctgcccagtgtattttctgatgsaaggagttgactttattccttttttttttttctcatcattctatcttgctgggctaatttccattttaatctttcttttgtcacattgtctttggtgggt

SEQ ID NO: 72458 - DNA, 201 bp, Homo sapiens
tcttgttaaaaaaaatttaataagaacaaaacaactggggggaggagccaagatggccgaataggaacagctccggtctacagctcccagtgtgagcgacrcagaagacgggtgatttctgcatttccatctgaggtaccgggtttgtctcactagggagtgccagacagtgggcgcaggccagtgggtgcgcgcaccgtg

SEQ ID NO: 72459 - DNA, 201 bp, Homo sapiens
tcctccattgcttaaaggataaaggccaaattccttagactaacatttaatgtctttcacagtttccctacacctgcctttcttgttgcctcttatttctyagcacaaaccctccagtcagatttcttactgtcctttgaatatgccttgacgttttctgcatgtgtgttcagttgttttccctgtttggacagattttcc

SEQ ID NO: 72460 - DNA, 201 bp, Homo sapiens
ctaacatcatgctttaaggtagcagaacctagaagcattcttattaaagacagggtcaataaaataaataatttctactgtcattattattattattattwtttttttttttgagacagagtctcgctctgttgcccaggctggagtgaagtgtcatgatctcggctcactgcaacctccacctcttaatcttaatccatt

SEQ ID NO: 72461 - DNA, 201 bp, Homo sapiens
gcttcagccaggagttcaaggctacagtgagctatggtggcaccactgcactctccagcctgggcaacagagcaggaccctttctttaaaaaaagaagatycttgatggatggatgggtaatgaattaaagaccagtggcagaattaagagtatgaaaagaaacactgattttctcaggttgcatttatgtttgttggaag

SEQ ID NO: 72462 - DNA, 201 bp, Homo sapiens
caaattccttagactaacatttaatgtctttcacagtttccctacacctgcctttcttgttgcctcttatttctcagcacaaaccctccagtcagatttcytactgtcctttgaatatgccttgacgttttctgcatgtgtgttcagttgttttccctgtttggacagattttcccctctcaccctattctttcttctgcc

SEQ ID NO: 72463 - DNA, 201 bp, Homo sapiens
aggctgcctgcctgagcgtccttgggcaagcagctccattcagtgtcatatccattttagacaaccccagggtgtgcgtcttaactcgccacacaaacccrattcctggggtcacggtgagtgagggtgaacgaacagtgctgctgcatccacggagaatcctgtgagggagagccccacatggagacctctgagcccttc

SEQ ID NO: 72464 - DNA, 201 bp, Homo sapiens
cagaaaaatgcacatatcataagtttatggcttgctgaattttcacaaagtgaacccactggagcgagatgctgtctcaaaaaaaaaaaaaaaaaaaaaaattgccacaaccccagaagtacctcctcttcttcctttccggattcaatctccatgcttgccaaggaaaccacagccctgacttctaacaccatgggttag

SEQ ID NO: 72465 - DNA, 201 bp, Homo sapiens
ctctctagatcaatggagatgacaagcaatttagaaaaaatattctgcctctcgtttggccttaccagaagcagaaatgatacaatttttaaacactgcartaatatttgctagttgggccttgccataacttgtaatgtcagggaagtctaattatgctttcacaaactgggagagctatttttgtgccagaactgtcct

SEQ ID NO: 72466 - DNA, 201 bp, Homo sapiens
tgtgatcgttgctgcccatgccacgcattccatttattccatcagcgtgtattattgagtgtctgccgtgtgtcagacactgctccggatgctggggatayggcactgggaaaaaattcctccctcatgatgatgaaggcaaacaataaataagatacataagtaaaaataggtagtcagcaggcaatacatactgagggg

SEQ ID NO: 72467 - DNA, 201 bp, Homo sapiens
acagaaaaatgcacatatcataagtttatggcttgctgaattttcacaaagtgaacccactggagcgagatgctgtctcaaaaaaaaaaaaaaaaaaaaaaattgccacaaccccagaagtacctcctcttcttcctttccggattcaatctccatgcttgccaaggaaaccacagccctgacttctaacaccatgggtta

SEQ ID NO: 72468 - DNA, 201 bp, Homo sapiens
acacacacacacacacacaccctctcaaaaaccaaggctttgagtagaagaaaagaaaaatttagagataagatttgaaaagggatacatggagtttagtyggataagaagaaagaatgttggcagaaaagagaaatgggtaacatggaggttttgggtaatactgggaaatatatacagctctgtcaacttttggagacc

SEQ ID NO: 72469 - DNA, 201 bp, Homo sapiens
catgaggtatgtcccttgtgtaccatgtttgctgagagttttaatcataaagtgatgctggattttgtcgaatgcattttctgcatctattgagatcatgycatttttttttaaattttgtttgtgtggtgtaccacatttattgacttgcatatgttaaaccatccctgcatccctggtatgaaatccatttgatcatgg

SEQ ID NO: 72470 - DNA, 201 bp, Homo sapiens
ccagcctggtgacagagcgagactccatctcgaaaaaacaaaaaaaagaactttatttcttcagatttatgttactgttttcatgtgtaaactataatttsaagttcttcagtgctgtctttatccattcattcatttatagtgcctgttatgttgcagctctgttctagggattgaggattgaacaacggatcggacagt

SEQ ID NO: 72471 - DNA, 201 bp, Homo sapiens
tcagccgcaggcaaccgctcacctgctagttctgtcttgcagatgtgcctgttctggacatttcgtataaatggaatcagacaatatgtggcctttcatgkctggcatctttcagcacagtgtttcgaggttcatgcatgtttgtagcacttcatttctaatattccattgtatggatataccacattttgtacatcagtt

SEQ ID NO: 72472 - DNA, 201 bp, Homo sapiens
gcgagactccatctcgaaaaaacaaaaaaaagaactttatttcttcagatttatgttactgttttcatgtgtaaactataatttcaagttcttcagtgctktctttatccattcattcatttatagtgcctgttatgttgcagctctgttctagggattgaggattgaacaacggatcggacagtgttagttttggtcatc

SEQ ID NO: 72473 - DNA, 201 bp, Homo sapiens
tgttaaccacgcacatatcgttaagaatctgaaatgctgctccatggggtctggcagaagcagggcctttgattagctaaccttagaaatgctggagaaarttttctgacttagcaagaaagcccctgaaaccttagaatggacatgagagtgagctttccgattgtcatgggggtttatcttgtgtagggaaaagaaaca

SEQ ID NO: 72474 - DNA, 201 bp, Homo sapiens
aggaattcttatattatggaccaaagttatttggtcatattctacccagtattctctgaatgattatttgaataaagatgattaattttgctatagtgcartttatcagtattttcctttatggataacgtttttggttgcaggggagttttgaactttctctcttttccctgaaggttcgataatttgagtctctgtaat

SEQ ID NO: 72475 - DNA, 201 bp, Homo sapiens
agtctgaaggagtgtgatctaaacaatgtgtagtgtttccactgaagcacagatgttttccctgtgatttgtagtgattggcattttcaaactgcaggttsctgtctatattaacttgacagtttgtaataactgcttgagattagcagtttgtctgtttcttcagtttagttaattgtcatatgtagctcctctgtgtaa

SEQ ID NO: 72476 - DNA, 201 bp, Homo sapiens
atcctatctcaaaagtctgaaggagtgtgatctaaacaatgtgtagtgtttccactgaagcacagatgttttccctgtgatttgtagtgattggcattttyaaactgcaggttgctgtctatattaacttgacagtttgtaataactgcttgagattagcagtttgtctgtttcttcagtttagttaattgtcatatgtag

SEQ ID NO: 72477 - DNA, 201 bp, Homo sapiens
tgcattccagtctgggtgacggagggagatcctatctcaaaagtctgaaggagtgtgatctaaacaatgtgtagtgtttccactgaagcacagatgttttycctgtgatttgtagtgattggcattttcaaactgcaggttgctgtctatattaacttgacagtttgtaataactgcttgagattagcagtttgtctgttt

SEQ ID NO: 72478 - DNA, 201 bp, Homo sapiens
cataaaacaggtgaaaggctagactagaaaaccttaaaggggctgggtgcggtggctcacgcctgttatcccagcactttgggaggttgaggtagacatcwcttgaccccaggagttcaagaccagcctgagcaacatagaccctgtctctacaaaaaaagttccaaaaattagctgggcatgatggcatgagcctgtagt

SEQ ID NO: 72479 - DNA, 201 bp, Homo sapiens
tgttaactttgagttaattttacataaacctgggttaatttacaaaattttggcaccaacaacatggttaggcaaggcagcatggatgggtattggaatcygtcaatctgggttgctgtataccagctctgggactgggggcaagttgtagcagccctgagcctcctgcttcacctgtatcaggggaggctgagacccacc

SEQ ID NO: 72480 - DNA, 201 bp, Homo sapiens
tagcatatgttaactttgagttaattttacataaacctgggttaatttacaaaattttggcaccaacaacatggttaggcaaggcagcatggatgggtatwggaatctgtcaatctgggttgctgtataccagctctgggactgggggcaagttgtagcagccctgagcctcctgcttcacctgtatcaggggaggctgag

SEQ ID NO: 72481 - DNA, 201 bp, Homo sapiens
ctcaagtgatccgcccgtctcggcctcccaaagtgttgggattacaggcgtaagccatcgtgtccagcctattgcttagctttaatgtgaatcagtgttarcatatacattcagaattctttaaacttcaaagaaaccacaaaattatgtatcatggaaatacaaatcagaacaaaaatctattgactgtgagcccacaaa

SEQ ID NO: 72482 - DNA, 201 bp, Homo sapiens
ctcctgacctcaagtgatccgcccgtctcggcctcccaaagtgttgggattacaggcgtaagccatcgtgtccagcctattgcttagctttaatgtgaatyagtgttagcatatacattcagaattctttaaacttcaaagaaaccacaaaattatgtatcatggaaatacaaatcagaacaaaaatctattgactgtgag

SEQ ID NO: 72483 - DNA, 201 bp, Homo sapiens
gtttttgagattaaaactttagggaaagaaacagctctcttaaaaatgtcagcaacttcaattcattgctttttaaatatcctggttaataatttacaccyttggttaaaatattcaatcatctacttaatatatagtgcttacctttgtttttattttattttttgagacatagtcttgcttgctctgttgtccgggctg

SEQ ID NO: 72484 - DNA, 201 bp, Homo sapiens
gtgtgtgtgtgtttttgagattaaaactttagggaaagaaacagctctcttaaaaatgtcagcaacttcaattcattgctttttaaatatcctggttaatwatttacacccttggttaaaatattcaatcatctacttaatatatagtgcttacctttgtttttattttattttttgagacatagtcttgcttgctctgtt

SEQ ID NO: 72485 - DNA, 201 bp, Homo sapiens
tgtccaccttcctgcttcctctccggtgatcttgtctattcttggccattttagagttgacttagcagccttcacaaaactggttggaatttccactgggwttaaattgataggtcatttttgggagacctttgcaatattgaactttccaatccgtgaacttatctgcccatgtattatgtttgtttttggtagattaca

SEQ ID NO: 72486 - DNA, 201 bp, Homo sapiens
agccctgaggctcatggtggttgctgttattctgttgaacgtgaaccctagcctttagaaaggagcaagtctttgtggaatacacaggatttgaagtgcawcaaaggggtggaaacgcagctgaccatgataccctcaagtgagtttttccactgaatttgattattttctcatttggcacttctttctgggctttctaag

SEQ ID NO: 72487 - DNA, 201 bp, Homo sapiens
gccttgggagtaaggattgtgagatgggcagaggagcgtgtatcatccaggtgggcacgatggaatcaatcacaagcgtccttataagtgggaagaagaarcgtcagactcaggcaatacgaagatggaagtggtggttgcagtgatacacgatcatagagccaaggtgtgtggaaagccgtcagcagaaggaagaggcat

SEQ ID NO: 72488 - DNA, 201 bp, Homo sapiens
tctctactaaaaacacaaaaaattagccgggtgtggtggcatgtgcctgtagttccagttacttgggaggctgaggcaggagaattacttgaacccgggasgcagagtttgtagtgaaccgagattgcaccactgcactccagcctgggtgacacagtgagactccgtctttccaaaaaaaaaaaaagatgtccacattca

SEQ ID NO: 72489 - DNA, 201 bp, Homo sapiens
tggcagaagcagggcctttgattagctaaccttagaaatgctggagaaagttttctgacttagcaagaaagcccctgaaaccttagaatggacatgagagkgagctttccgattgtcatgggggtttatcttgtgtagggaaaagaaacaggtctgaatccagagctggacctgatgcttctactttctttcttttttttt

SEQ ID NO: 72490 - DNA, 201 bp, Homo sapiens
tagtactttgttttgttttcaaatacatgtgtttacgattatagatttcccccaccccagagttagtcacatcccacaagttttctacttttgtaaaattrtattgaagtataatatacctgagagaaagtgtgccatcttaaatgtacaggtggatgaattatcacaatgtaaatgaatctctgtaactagcaccaagat

SEQ ID NO: 72491 - DNA, 201 bp, Homo sapiens
tcctgcagaagttctatatttgcaacatatctaacaggattagatttcagactacataaagaatttctacaagtcaattaaaatacatccagtgaaaaaayaagcaacatatggacaatagacattttgcagaagaagcaatttggcaaataaaatcacgggaaggcattaaagctgtttggaaaacagggaaataagacc

SEQ ID NO: 72492 - DNA, 201 bp, Homo sapiens
ccatgcaaaagctcattagtttaattaagtcccaactatttatctttgtttttattgcatttgcttttgggttcttggtcatgaaatccttgctaagccartgtctagaagggttttccaatgttatcttctagaatttttacagtttcagatcttaggtttaagtcctcaatccatcttgagttgatttttgtataaggt

SEQ ID NO: 72493 - DNA, 201 bp, Homo sapiens
taggctatagtgcagtgatgaatcatagctcatagcagccttaaattactgagctcaagtgatccaatcctccctcctcagccttccaagtagctgggacracaggtgtgcgtcaccatgaccaattaactttttttttttttttttttttgctgtgacaggtctcactatgttgcctggggtggtattgaagttctggcc

SEQ ID NO: 72494 - DNA, 201 bp, Homo sapiens
tatagtttgaaatcaggtagtgtgatgcctccagatttgttctttttgcttagtcttgctttggctctgcgggctcttttttggttccatatgaattttaraatttgttttttctaattctgtgaagaataatggtggtattttgatgggcattgtgttgaatttgtagattgcttttggcagtatcatcattttcacaat

SEQ ID NO: 72495 - DNA, 201 bp, Homo sapiens
agatgggggctggttcccagcatgtgccttttacattttattagggatggggtccacacacccttctgatgtgaaatgtcatgataatgatgaaggaaaamtaaataagaaatagcctctgtatataaagagtaatcagagttaatataggaagggaacttcctagataaaatgctaggagtaaatttcatgggcagtgtg

SEQ ID NO: 72496 - DNA, 201 bp, Homo sapiens
tagctactttcacccagggtgagcaaggtggaagctgccatgtgttttataatgtagcctaggaaatttgaactatctttttgataacacaggtcagccayatttaatatgagagagaactacacaaggcctggatagcggaagtgaaaatcactgggggccatcttggaggctggctgccacagagattagcaactggaa

SEQ ID NO: 72497 - DNA, 201 bp, Homo sapiens
ttcaagaagaacgtgtaacttggaaaatctgaagtagtcagcaactttagggactgggaaggcagctttcccagggataactaagtgataaagcgaactgygtccagaatatattttaagtacttactaatgtgaaagcattgtggaatcttcacgtcttctaaaagtcacgtttttacgtgactgattgcaaatgcaaca

SEQ ID NO: 72498 - DNA, 201 bp, Homo sapiens
taacagtttgacttcctctttaccgatttggatgccctttcttttgtctgatttctctgggtaggacttacagtactatgttgaggagtggtgaaattggkcatccttgtcttgttccccttctcagagggagtgctttcaacttttccccatttagtattatgttggctgtgggtttgtcattgatggcttttattacat

SEQ ID NO: 72499 - DNA, 201 bp, Homo sapiens
tctttaaaaaatgacttttcatgatgaatagaacataagttttactaatgctataatcagtataaattccttgcagatcaaggacagtgaggccatgtctrataatccagaggcagaacttggatttgggagataactcccccctcttgcactctctgtgacaagtctagtttcgatatcaagtttatcttaatctcaaaa

SEQ ID NO: 72500 - DNA, 201 bp, Homo sapiens
agtttcactcttgtcgcccaggctggagtgcagtggcacaagctaggctcactgcaacctccacctcctgggtttaagctattctcctgcctcagcctccygcgtagctgggaccacagaatgtgatcccacagctgtgaccacacctggctaattttttatttttttgaactggagtctctctttgttccccaggctagt

SEQ ID NO: 72501 - DNA, 201 bp, Homo sapiens
atctcctggaaattccttgtttgtttttccattctgatgttttactaaagctatggatcatctttgagtaattcttctgtaacagattgtgtgtgtgtgtkcacgtgctcatgtgtgcttatgtgcacatggtatgcgtgtgtgcatacacacgagtgtgtgtgcgtgtctgagcacaaacacgtatctgtctttacttca

SEQ ID NO: 72502 - DNA, 201 bp, Homo sapiens
gtatgttccttctttgtcctgcaagacaacggtaaagtgcattataattaatttatgtgtaatccaagtaaacaagcctcattgtgttgtatgtgtcttaygattaagagctcaatacatttaatctagtctgacagtttgcctggtgtaagtcatgtgtgtcttgttaaaaaaaatttaataagaacaaaacaactgggg

SEQ ID NO: 72503 - DNA, 201 bp, Homo sapiens
gttcaaggtcgtgacttataatctcacccacagtgtaaggaagttcttttaatacattgcatgattgtatgagagatctcactgttccatctctttactgrcacttggtattttctgtccttttaattttagactttgtagtacctgtgaaagctgtttgtcattgtggttttaatttggatcgtagtttattacagacat

SEQ ID NO: 72504 - DNA, 201 bp, Homo sapiens
cactgccaatattgttgaaaggaccatactatccaaagcaatctacagattcaatgcaatcttttgagatggaatctcgctctgttgcccaggctggagtrcagtggtgcgatcttggctcactgcaagctccacctcccgggttcatgtcattcttctgcctcagcctccagagtagctgggactacaggcgcccaccac

SEQ ID NO: 72505 - DNA, 201 bp, Homo sapiens
cacatttttcagactccatatgtttattggtatatatattctaaagacacagaccgtaaaggcctactgaacattactcagtctcttggtagttttgataytattttgtatgtattctgggattgaacaattgagaaactatatcgatgcttttggaaaacaggattctcactgcggaagaaagaatatgtaaatatggaa

SEQ ID NO: 72506 - DNA, 201 bp, Homo sapiens
tggtgacagagcgagactccatctcgaaaaaacaaaaaaaagaactttatttcttcagatttatgttactgttttcatgtgtaaactataatttcaagttmttcagtgctgtctttatccattcattcatttatagtgcctgttatgttgcagctctgttctagggattgaggattgaacaacggatcggacagtgttagt

SEQ ID NO: 72507 - DNA, 201 bp, Homo sapiens
tgtgtgtgtgtgtgtgtgtttttgagattaaaactttagggaaagaaacagctctcttaaaaatgtcagcaacttcaattcattgctttttaaatatcctsgttaataatttacacccttggttaaaatattcaatcatctacttaatatatagtgcttacctttgtttttattttattttttgagacatagtcttgcttg

SEQ ID NO: 72508 - DNA, 201 bp, Homo sapiens
gcaggctagagacctgggaggctgtacagctctgcactgggctgcagatggaggccactgcagtgtgattgagtggatgataaaggatggctgtgaggtaygggacctgccttgttaaccacgcacatatcgttaagaatctgaaatgctgctccatggggtctggcagaagcagggcctttgattagctaaccttagaaa

SEQ ID NO: 72509 - DNA, 201 bp, Homo sapiens
caccaaagtgtgtgtgtgtgtgtgtgtgtgtgtgtgtgtgtgtgtgtttttgagattaaaactttagggaaagaaacagctctcttaaaaatgtcagcaayttcaattcattgctttttaaatatcctggttaataatttacacccttggttaaaatattcaatcatctacttaatatatagtgcttacctttgtttttat

SEQ ID NO: 72510 - DNA, 201 bp, Homo sapiens
catcaagctaccaatgactttcttcacagaattggaaaaaaactactttaaagttcatatggaaccaaaaaagagcctgcatcgccaagtcaatcctaagycaaaagaacaaagctggaggcatcacactacctgacttcaaactatactacaaggctacagtaaccaaaacagcatggtactggtaccaaaagagagata

SEQ ID NO: 72511 - DNA, 201 bp, Homo sapiens
tccattttatttttgtttcctttttattggcaccaccaaagtgtgtgtgtgtgtgtgtgtgtgtgtgtgtgtgtgtgtgtttttgagattaaaactttagrgaaagaaacagctctcttaaaaatgtcagcaacttcaattcattgctttttaaatatcctggttaataatttacacccttggttaaaatattcaatcatc

SEQ ID NO: 72512 - DNA, 201 bp, Homo sapiens
cccccctcctcctcttcctttagcttggggatcatcattacctccatttctccattttatttttgtttcctttttattggcaccaccaaagtgtgtgtgtrtgtgtgtgtgtgtgtgtgtgtgtgtgtgtttttgagattaaaactttagggaaagaaacagctctcttaaaaatgtcagcaacttcaattcattgctttt

SEQ ID NO: 72513 - DNA, 201 bp, Homo sapiens
tatctacccccctcctcctcttcctttagcttggggatcatcattacctccatttctccattttatttttgtttcctttttattggcaccaccaaagtgtrtgtgtgtgtgtgtgtgtgtgtgtgtgtgtgtgtgtttttgagattaaaactttagggaaagaaacagctctcttaaaaatgtcagcaacttcaattcatt

SEQ ID NO: 72514 - DNA, 201 bp, Homo sapiens
atatctacccccctcctcctcttcctttagcttggggatcatcattacctccatttctccattttatttttgtttcctttttattggcaccaccaaagtgygtgtgtgtgtgtgtgtgtgtgtgtgtgtgtgtgtgtttttgagattaaaactttagggaaagaaacagctctcttaaaaatgtcagcaacttcaattcat

SEQ ID NO: 72515 - DNA, 201 bp, Homo sapiens
tatatctacccccctcctcctcttcctttagcttggggatcatcattacctccatttctccattttatttttgtttcctttttattggcaccaccaaagtrtgtgtgtgtgtgtgtgtgtgtgtgtgtgtgtgtgtgtttttgagattaaaactttagggaaagaaacagctctcttaaaaatgtcagcaacttcaattca

SEQ ID NO: 72516 - DNA, 201 bp, Homo sapiens
acatatatctacccccctcctcctcttcctttagcttggggatcatcattacctccatttctccattttatttttgtttcctttttattggcaccaccaaygtgtgtgtgtgtgtgtgtgtgtgtgtgtgtgtgtgtgtgtttttgagattaaaactttagggaaagaaacagctctcttaaaaatgtcagcaacttcaat

SEQ ID NO: 72517 - DNA, 201 bp, Homo sapiens
taacatatatctacccccctcctcctcttcctttagcttggggatcatcattacctccatttctccattttatttttgtttcctttttattggcaccaccyaagtgtgtgtgtgtgtgtgtgtgtgtgtgtgtgtgtgtgtgtttttgagattaaaactttagggaaagaaacagctctcttaaaaatgtcagcaacttca

SEQ ID NO: 72518 - DNA, 201 bp, Homo sapiens
agtgaaataggaaagaatgaaaataacatatatctacccccctcctcctcttcctttagcttggggatcatcattacctccatttctccattttatttttrtttcctttttattggcaccaccaaagtgtgtgtgtgtgtgtgtgtgtgtgtgtgtgtgtgtgtgtttttgagattaaaactttagggaaagaaacagctc

SEQ ID NO: 72519 - DNA, 201 bp, Homo sapiens
agagtttcactcttgtcgcccaggctggagtgcagtggcacaagctaggctcactgcaacctccacctcctgggtttaagctattctcctgcctcagcctsctgcgtagctgggaccacagaatgtgatcccacagctgtgaccacacctggctaattttttatttttttgaactggagtctctctttgttccccaggcta

SEQ ID NO: 72520 - DNA, 201 bp, Homo sapiens
tcccacttggtgctacctgttctgtaagctcttgctatatatatgtattttaaaaatccagcaggcagcagttttctgctacacgtttctttctgtttttktttgtttgtttgtttgttgtttgttttttgttttttgagacggagtctcactctgttacccaggctgcagtgtggtggcactagcttggctcactgcaac

SEQ ID NO: 72521 - DNA, 201 bp, Homo sapiens
ttagtaagtataagtgtgtatatatattattactgtcttgttccagaaaggatgtaaagctgcttacaacaatacataaaagtaagaaaaatgaatgctargtgaggaaagttaggcaagagaaaataagaactccccaggggccaagtggaaagtagttcagttaacttttctagcccatcttttttccactttaaagga

SEQ ID NO: 72522 - DNA, 201 bp, Homo sapiens
gagtgttttgtatggagacttaaaatttatctaaaacctttatagaaggatgcagtttgactctcaaaccaagtcgtcttatcttgtacaatttcagaaaygaagaactcagaccaaatctattctctggggaaaatgttggcatttttaaaggtcattcgttttccaccaagaaagtttcaaatacttttccttttaact

SEQ ID NO: 72523 - DNA, 201 bp, Homo sapiens
cctccctcatgatgatgaaggcaaacaataaataagatacataagtaaaaataggtagtcagcaggcaatacatactgaggggcagcagcataggaaaaaytgagggcctggggtagaggtggggaagtcttcaccaagaaggtagcttctgagtagatctgaagcaaggatacctggagccttgcaactatctgggggaa

SEQ ID NO: 72524 - DNA, 201 bp, Homo sapiens
gttccttttatatttattagttggcagtcttctgtgaaaaacagcttccccccaccaactggggatggactacattttatccttaaaaaaaaaaaaaaaaagaaaatatttaatttttaaataccaatttttagagtaagaaattggtttgatagttatctctaatagtgtcaaatgagtattttttttcctttttctctt

SEQ ID NO: 72525 - DNA, 201 bp, Homo sapiens
acagttttcccattgcacttagaaaataatttctgggataattcattgccatgtgaatattccattccccattaacttttattttttatttatttttttttattttttgagacagagtcttgctctctctcccaggttggagtgcagtggcatgatctcggctcactgcaacctccgcctcctgggttcaagtgattctcc

SEQ ID NO: 72526 - DNA, 201 bp, Homo sapiens
acttttcagagtacttggatcattgctatttatattttgtccagagtttcaaattgtgatcagtggaaatgacaggccgtagcatacatacgccatcctgrccagcatcacaggtggtcagtacatctttctgttgttgttttgagacagggtctcactctgttgcccaggctggagcacagtggcatgatcagggatcac

SEQ ID NO: 72527 - DNA, 201 bp, Homo sapiens
ttactaatgctataatcagtataaattccttgcagatcaaggacagtgaggccatgtctaataatccagaggcagaacttggatttgggagataactcccscctcttgcactctctgtgacaagtctagtttcgatatcaagtttatcttaatctcaaaaaatgagcttggctctgttccctctattttctcttaaaagtt

SEQ ID NO: 72528 - DNA, 201 bp, Homo sapiens
aggcggaggttgcagtgagccaagattgtgccagtgcaatccagcctgggcgatagagtgagactctgtctcaaaaaaaacaaacaaaaagtcatgcagayaattagagttctatttgaatataatttaaaaaatgaagttttcttcccttagcaaaggtcattctaaagacctttgagtgcttgggaaagcagtatgaac

SEQ ID NO: 72529 - DNA, 201 bp, Homo sapiens
gagtacttggatcattgctatttatattttgtccagagtttcaaattgtgatcagtggaaatgacaggccgtagcatacatacgccatcctggccagcatyacaggtggtcagtacatctttctgttgttgttttgagacagggtctcactctgttgcccaggctggagcacagtggcatgatcagggatcactgcattct

SEQ ID NO: 72530 - DNA, 201 bp, Homo sapiens
ggagaatcactagaacccaggaggcggaggttgcagtgagccaagattgtgccagtgcaatccagcctgggcgatagagtgagactctgtctcaaaaaaaacaaacaaaaagtcatgcagataattagagttctatttgaatataatttaaaaaatgaagttttcttcccttagcaaaggtcattctaaagacctttgagt

SEQ ID NO: 72531 - DNA, 201 bp, Homo sapiens
agtttagaagattcttagcagtctaagacaagaaaagatttaatggccacaaagaaattggaattttcagtaaaatgagtcattttacccacctaagcccygtgagaaccaccggctttgactctgcagtagctgtactgagcatgcttatctcttttctctgcttttcccaagccgtgttaaggttgatgttcccaataa

SEQ ID NO: 72532 - DNA, 201 bp, Homo sapiens
agaagacaatttatagcagaatcaatataagcaattcatataaagatgtttagcattactagtaataacaatttttctatcaaattggtgattaaaaaatwcatgttggtaaagatgcagtgaaataacctgtactttcaaatatagttgatagaaatgtgaattggtatcatctttctggaaagcaatttggaaatgtgc

SEQ ID NO: 72533 - DNA, 201 bp, Homo sapiens
gtcgattaaaggtgaaaacctttatttgtgtagatgcaaaacaaaaattgggtgtaacttggcatgtatgttaaaaagtatctttttttttttttttttttgagacggaatctcactctgtcctccagattggagtgcagtggcgcgatctcagcccactgcaagctctgcctcccgggttcacgccattctcctgcctca

SEQ ID NO: 72534 - DNA, 201 bp, Homo sapiens
ttgtatgtttgtttgtgtgtaggtatttataaatctcttccatccctcctatgagggccataccagagggtaaggtattaggaaattttttaacgtaacaytttccatcagtcgattaaaggtgaaaacctttatttgtgtagatgcaaaacaaaaattgggtgtaacttggcatgtatgttaaaaagtatcttttttttt

SEQ ID NO: 72535 - DNA, 201 bp, Homo sapiens
gtttgaaagagaagaataactggttatagagaaaatgtaaacatgaaaagaagtttgtgtctataatagtagataatttcattgaaatggatactttttttctgagaaaatttaaaccgccaagtcaacccaagaagcagaaaattcgaaataaccaatatccatgcaagaaactagaaaattcatttaaaaattacctcc

SEQ ID NO: 72536 - DNA, 201 bp, Homo sapiens
ggggctggatattccagttatcactcagaggctttgcacgtttccctattgagaagatcttctgttttattttccaactctctattttgaaatatttacayatttagaaaaaatgaaagaatagtacaacaaacacctgtataccccccacctaggcttggcagttgacatttggccatatttgcctctcctttttttttt

SEQ ID NO: 72537 - DNA, 201 bp, Homo sapiens
ggtgtttgggtgtttgcccgaaatgtcaggtcagggtttagatgccaatcctgccggtttcttgccctgaaaaccactgagctgtatgatttaagtcagtkaatttatagtgtgcagatttcatctgaataaagctgtttaaaaaaaagttcagagaagatgttttttactgagctctgacccaaaccaggatcacccttg

SEQ ID NO: 72538 - DNA, 201 bp, Homo sapiens
cggtgtagagaggtggttggggctgtgcccttagaactttccttaacatctcaagcagttagcacgttttggaagatttttaggcatcccctttcttttttaacactttgcgggaggatcacatttacttatgatgttcatctgtattcaaaatttggtaagaatggaagcatatagtgaactggtcgatactgcagtgtt

SEQ ID NO: 72539 - DNA, 201 bp, Homo sapiens
agtgagccaagattgtgccagtgcaatccagcctgggcgatagagtgagactctgtctcaaaaaaaacaaacaaaaagtcatgcagataattagagttctrtttgaatataatttaaaaaatgaagttttcttcccttagcaaaggtcattctaaagacctttgagtgcttgggaaagcagtatgaacaccctaaacccag

SEQ ID NO: 72540 - DNA, 201 bp, Homo sapiens
agaccaggcagtttacacaaaaacacttgatattgactatgaaacaagatccggaagagaacaaatataaatacagatggatcagctaaatgaaggactgycgagtaaaaacacaaagaagatgtttgtgagtggagggggatggatctccttctccacccagcagtgaatatcatgggaatctctctctacctgaatcta

SEQ ID NO: 72541 - DNA, 201 bp, Homo sapiens
gcttggcccttggaggaccttggtggctttctgccagtgggaggtggtaagttcagggctgtgcctatccctgggaaggaagagcgcctggtctcaatgasctcattgctgggcaatccagagcctccggggctggagtctctggattgttaaaataatccaggattattaaacaatcctcctcaccacctagagcaaatt

SEQ ID NO: 72542 - DNA, 201 bp, Homo sapiens
tatcttgtaatgtgaaaggaataaatgcattgaaaggaatcattaagaaaaagattgagtgtattatatatttttaaaaacttaattacaatgttaaggayattccagggaaatatttacaaatgtattagagacaaattaccagcatctttaatgtacagaacacacacatgcccatacatatactccaaaaaagcctcc

SEQ ID NO: 72543 - DNA, 201 bp, Homo sapiens
aattccagatgaattaagaattaaatgtaaaaaacaaaaccataaaaaatgaccagaaaacacagaggcataattattttatcttgtaatgtgaaaggaayaaatgcattgaaaggaatcattaagaaaaagattgagtgtattatatatttttaaaaacttaattacaatgttaaggacattccagggaaatatttacaa

SEQ ID NO: 72544 - DNA, 201 bp, Homo sapiens
tcttcttttgagaaatgtctttagatcatttgcctatatttaagttgcatagtttgagaatacaaacaaatggaaagacatcccatgctcatggatcagargaattaatttttttgaattaagcagaaattttatttccaagctctttaaagattattgcaaacacaaagttgtcttctgaaagccccaaatcaaatcaaa

SEQ ID NO: 72545 - DNA, 201 bp, Homo sapiens
tcttctaaaatgtcagcaattaaacacgtccgaggctgggtcttgtatttattagagaccccgtcttactccccgccccccgccccacacccctagtctgygacttgaaggagagagagagaaaagaagagctttgtccaagtgtatttgattcattcttaggggttctacaagttaggacactcaaaaaatgtttgtaat

SEQ ID NO: 72546 - DNA, 201 bp, Homo sapiens
tactcatgattttagtttggtagtttggttcattaattgtaagtagcccatttttcttctaaaatgtcagcaattaaacacgtccgaggctgggtcttgtrtttattagagaccccgtcttactccccgccccccgccccacacccctagtctgcgacttgaaggagagagagagaaaagaagagctttgtccaagtgtat

SEQ ID NO: 72547 - DNA, 201 bp, Homo sapiens
ttccagtgaagagtgaaataggaaagaatgaaaataacatatatctacccccctcctcctcttcctttagcttggggatcatcattacctccatttctccrttttatttttgtttcctttttattggcaccaccaaagtgtgtgtgtgtgtgtgtgtgtgtgtgtgtgtgtgtgtgtttttgagattaaaactttagggaa

SEQ ID NO: 72548 - DNA, 201 bp, Homo sapiens
cacaaactgtaactcaagtgcttttccagtgaagagtgaaataggaaagaatgaaaataacatatatctacccccctcctcctcttcctttagcttggggktcatcattacctccatttctccattttatttttgtttcctttttattggcaccaccaaagtgtgtgtgtgtgtgtgtgtgtgtgtgtgtgtgtgtgtgtt

SEQ ID NO: 72549 - DNA, 201 bp, Homo sapiens
aggctgaggcaggcagatcacgaggtcaagagatcaagaccatcctggccaacatggtgaaaccccgtctctactaaaaatacaaaaattcgctaggtgtrgtggcgggtacctgtaatcccacctacttgggaggctgaggcaggagaatccttgaacccgggaggcggagtttgcagtgagctgagatcgcaccactac

SEQ ID NO: 72550 - DNA, 201 bp, Homo sapiens
aggctcttggaggcagccactcctcatcgattatttgcacatgagataaacctgtttgttttaccatattgaaggactaacagaagcacaaactgtaactmaagtgcttttccagtgaagagtgaaataggaaagaatgaaaataacatatatctacccccctcctcctcttcctttagcttggggatcatcattacctcc

SEQ ID NO: 72551 - DNA, 201 bp, Homo sapiens
ggaaggaacttagaccttctggcttctcctttggggatactcctccctctaggacaagtgttgggtctgttctttagccacacactttgtgccatgcctcrtcctttaggagaaagaatccagtgggggctgggagtgagtgggcaaggctgtttgatgattaggtgaggtgttagctcacccacctgatccagatctgac

SEQ ID NO: 72552 - DNA, 201 bp, Homo sapiens
tcagatccttcccactaaggtcaacaatacccaggctcttggaggcagccactcctcatcgattatttgcacatgagataaacctgtttgttttaccataytgaaggactaacagaagcacaaactgtaactcaagtgcttttccagtgaagagtgaaataggaaagaatgaaaataacatatatctacccccctcctcct

SEQ ID NO: 72553 - DNA, 201 bp, Homo sapiens
aaattaagtgtcatataagtgttgccgcattgcagttctcctcagtaacggcctgtgacctgccatttctgtcggctcttaccaaggctcggtgccgcccygggcctctgctccattgtcatagtaatgtttgcactctgctagtcacctgtaaatatacatatttaggatcctaaaaccaatatcctaaaatatgtatat

SEQ ID NO: 72554 - DNA, 201 bp, Homo sapiens
ctgttctgctagtaaaaagccctaatttctttggataacttactaattattgagtcttcctcatctgcacaacatggttagaagctccttcagagttacgyctgggtccttatttctgtttttttctccactgcatacctttgtgtccttcctgttaaccttatatagggcgggctccctgcacagaaggaggagatgata

SEQ ID NO: 72555 - DNA, 201 bp, Homo sapiens
tctgacattttgcatttgggcaagtatatctgcagaatgaatgtctagatgtggactaggtagttagttttgataattgttaaatcactctcctctagacrggttataccagtttatacttctagtagcaatatgagtgaatacctctttcgcacagcctcctcaactcaatgtgttaccaaacttagaatttttactgtt

SEQ ID NO: 72556 - DNA, 201 bp, Homo sapiens
ttttacaattataagcaaagctgcaagaaacaatgtgtatctgacattttgcatttgggcaagtatatctgcagaatgaatgtctagatgtggactaggtrgttagttttgataattgttaaatcactctcctctagacgggttataccagtttatacttctagtagcaatatgagtgaatacctctttcgcacagcctcc

SEQ ID NO: 72557 - DNA, 201 bp, Homo sapiens
tgctacatttgtggtaactaattatagcagcaataggaaacttagaagagctgtttttacaattataagcaaagctgcaagaaacaatgtgtatctgacaytttgcatttgggcaagtatatctgcagaatgaatgtctagatgtggactaggtagttagttttgataattgttaaatcactctcctctagacgggttata

SEQ ID NO: 72558 - DNA, 201 bp, Homo sapiens
gctgctacatttgtggtaactaattatagcagcaataggaaacttagaagagctgtttttacaattataagcaaagctgcaagaaacaatgtgtatctgasattttgcatttgggcaagtatatctgcagaatgaatgtctagatgtggactaggtagttagttttgataattgttaaatcactctcctctagacgggtta

SEQ ID NO: 72559 - DNA, 201 bp, Homo sapiens
cgaagatggaagtggtggttgcagtgatacacgatcatagagccaaggtgtgtggaaagccgtcagcagaaggaagaggcatggaaacggactctcccctrgagcctccagaaggaaccagcctttgattttagctccgcaagacgcgttttggacttctgacctctgggctcataataagataagtttctgttgttttaa

SEQ ID NO: 72560 - DNA, 201 bp, Homo sapiens
tcggtgtagagaggtggttggggctgtgcccttagaactttccttaacatctcaagcagttagcacgttttggaagatttttaggcatcccctttcttttttaacactttgcgggaggatcacatttacttatgatgttcatctgtattcaaaatttggtaagaatggaagcatatagtgaactggtcgatactgcagtgt

SEQ ID NO: 72561 - DNA, 201 bp, Homo sapiens
aaaatgcttctgtgtggtggtaatttgcattcagtttgagagtgttttaatgagtcacagaggcatgcactttgtttgaataaagaatgaacagccttttytttccccccaggtaaagtacacagattcttgcttaaatgaggcttacaattttaatcagttgggcccttataaagaaagaaaaacagctgctacttgtta

SEQ ID NO: 72562 - DNA, 201 bp, Homo sapiens
tttccagcagctcaggtgtcatctggatgaaaatgttcctcgatgtctgagacagagtggcccaccctcctggtttgtatacctctgcttgcctctctcckgtggaatggtaccttgttgttgttctgtgagttgtttgtctccctctgtctcccttaagacctttgctgctgtggtgcccagcaggaaatacatacacac

SEQ ID NO: 72563 - DNA, 201 bp, Homo sapiens
agattgtgccactgcaatccagcctgggcaacagagtaagactgtctcaaaaaaataaattaaaaaaaggggaaggaaaatgaattaaaggaggatttacktaactaaaagacagttttaaaagaacaactgccgacactcataacattagcagcaatcgctttagcattttgtgttgattgctttgctccaccaagaata

SEQ ID NO: 72564 - DNA, 201 bp, Homo sapiens
gagctatggagaatggtccaagggaggagaacaagaactggattaagtgttgaagcaggaaagaagaaagagctggaaatgacacacacacacacacacaccctctcaaaaaccaaggctttgagtagaagaaaagaaaaatttagagataagatttgaaaagggatacatggagtttagtcggataagaagaaagaatgt

SEQ ID NO: 72565 - DNA, 201 bp, Homo sapiens
cccgacagaccccagtgtgtgttggtcccccccatgtgaccatgtgttctcatcattcagctcataagtaagaacatgtagtgtttggttttctgttcctscattagtttgctgaggataatggcttccagctccatctatgtccctgcaaaggatatgatcttgttcctttttatggctgcatagttgtaacatcaaagt

SEQ ID NO: 72566 - DNA, 201 bp, Homo sapiens
ggagctatggagaatggtccaagggaggagaacaagaactggattaagtgttgaagcaggaaagaagaaagagctggaaatgacacacacacacacacacaccctctcaaaaaccaaggctttgagtagaagaaaagaaaaatttagagataagatttgaaaagggatacatggagtttagtcggataagaagaaagaatg

SEQ ID NO: 72567 - DNA, 201 bp, Homo sapiens
atctatgttctaaggcagtggaaggaagcagggttggggaggatatatcatgttcaaggaaaatgaaaagaacttaatgttttgaaagacttctagtcaamggaactatgactcattatcctggatgtgatgggaggtggggggcatttaagcccacattcccacttccattttaaagtcagaatcaggaggaaaatgggg

SEQ ID NO: 72568 - DNA, 201 bp, Homo sapiens
atgtcagggagggtgttggggatgtcaagggccagggaaagggtctgggttggagagacagactccagagtcatcagcatgaggctggattggaattctgsgggagggagtttagagaagaaagggaagtctggtaactgagtcttggggcttttcaatatttatttagcttcttatgtttcatatttgctcagctcttgc

SEQ ID NO: 72569 - DNA, 201 bp, Homo sapiens
agttaattttacataaacctgggttaatttacaaaattttggcaccaacaacatggttaggcaaggcagcatggatgggtattggaatctgtcaatctggkttgctgtataccagctctgggactgggggcaagttgtagcagccctgagcctcctgcttcacctgtatcaggggaggctgagacccaccttgcaggggtc

SEQ ID NO: 72570 - DNA, 201 bp, Homo sapiens
gagcctgggaggtcgaggctgcagtgagccatgattgtgccactgcactccagcctgggtgacagagtgagaccctgtctcaaaaaaaaaaaaaaaaaaaagttatgtttttcttcttagtcttcatatcatctctgacttatttcttccccttgatagatttaccacttgaaaaatgcaaaatgactattttgtgattca

SEQ ID NO: 72571 - DNA, 201 bp, Homo sapiens
tgagcacttcactttggaaaagcaaaaaatcaaaggctgtcttaaagattgtacagaaaatatgatttattggagatatcccttgcctccaagctctaatrttaagcctccaaatataatgcaagttatattggtatagaaaatgggaaggagcaggcagatttattatgtatgagcatgaataatttttatctttattgc

SEQ ID NO: 72572 - DNA, 201 bp, Homo sapiens
cacattcattgaaacaaggctgtgctgactgtagaaattgttttctgtttggaaggttttgttttctgttgggagtattctgattctcagtcttacttctyttctgttattaccaacattttgttggtgatcatgattcttaatgaaacagttctgcataccatttcaaccatcagagtttttagtctccattgttttata

SEQ ID NO: 72573 - DNA, 201 bp, Homo sapiens
atgttttcattagatgatgtattctttgcctgcaggctctgccagacttgcctctttatcccgagacctcacttaaggcacctcattcccagattagaatrtatgtaaactatatgcattttgaacacgtcttcctgtaggctccctctgcacctgcctcccccatgcacctggtttgtatttgtttggtgtccaatgttc

SEQ ID NO: 72574 - DNA, 201 bp, Homo sapiens
aagatctcctggaaattccttgtttgtttttccattctgatgttttactaaagctatggatcatctttgagtaattcttctgtaacagattgtgtgtgtgygtgcacgtgctcatgtgtgcttatgtgcacatggtatgcgtgtgtgcatacacacgagtgtgtgtgcgtgtctgagcacaaacacgtatctgtctttact

SEQ ID NO: 72575 - DNA, 201 bp, Homo sapiens
catgcaggcctcctgtagctcagaaccttgttttgtatgccacatagcatttagctctgttgggcttattttacttgtttacttgtttgcttagtttgtttaccttgttgtttacttgtttacttcttgttcctttcctgcctcctcacccagtattaaactcagtgagagacaaataagacttctgcctgcttaacgctc

SEQ ID NO: 72576 - DNA, 201 bp, Homo sapiens
aaatagtatatgtaaagagtttagaacactcatacaaagtcttgtgaaaacttagctattaaataacccaggtttgggcagggatgttggatggactcctrggtaaaatagagttggccctaattgtgctgataattgaagctgggtaacagatacaagaggatttgctatactattcgttctactttttatgttgaaatt

SEQ ID NO: 72577 - DNA, 201 bp, Homo sapiens
ttgttagatgatgttgaactttgaaaggccaccaaggacacttttaatatcaaatcttcctcatccccccaactccagaaaactagtttttgctcagataytggctcagtggaaaatgtgtggtctgaagctgtagtctcctagtttgtgagcttattttcgctgcctgaaggtttgagtcaccgtagaaggggaggaggg

SEQ ID NO: 72578 - DNA, 201 bp, Homo sapiens
gtaattcttctgtaacagattgtgtgtgtgtgtgcacgtgctcatgtgtgcttatgtgcacatggtatgcgtgtgtgcatacacacgagtgtgtgtgcgtktctgagcacaaacacgtatctgtctttacttcagcaccactcttcatggattggcgatgtcttcattggaattggaagcgacaatatttacattttctta

SEQ ID NO: 72579 - DNA, 201 bp, Homo sapiens
tcatgcaggcctcctgtagctcagaaccttgttttgtatgccacatagcatttagctctgttgggcttattttacttgtttacttgtttgcttagtttgtttaccttgttgtttacttgtttacttcttgttcctttcctgcctcctcacccagtattaaactcagtgagagacaaataagacttctgcctgcttaacgct

SEQ ID NO: 72580 - DNA, 201 bp, Homo sapiens
aatggttgctgtaaatatctgatcaagccatgataaactgctttgaggtgacagccaccactgttctcatatagcatccccctcagtgtgcagtcatcttyactgtggaccatatgccaccggaggctagactgcagatgccccttgccagtgaaatttgacttcggtaaattttcagatgagttttggaagagcagggaa

SEQ ID NO: 72581 - DNA, 201 bp, Homo sapiens
tggttgctgtaaatatctgatcaagccatgataaactgctttgaggtgacagccaccactgttctcatatagcatccccctcagtgtgcagtcatcttcaytgtggaccatatgccaccggaggctagactgcagatgccccttgccagtgaaatttgacttcggtaaattttcagatgagttttggaagagcagggaaac

SEQ ID NO: 72582 - DNA, 201 bp, Homo sapiens
aggaacattatcagtggggcgtacactaaccattggcatttctgagcaacgtgttgcgtagttgtgtgatttggcagcagctggtccattgctgacacgtrtgtgtgttcactgaggcttcactcacacctaaggcttccttggagagaccatgctgccattacatttggatcactacctgcccccaacacacacacacac

SEQ ID NO: 72583 - DNA, 201 bp, Homo sapiens
tctgatctctagtaggattctaggctggatgtctttggaattgaaatacttgttggcttctggttattttgggggtaatccataacagtctaccattcctkgtgtttggttttagtgggctgtgaaaaaaatcatttgttcaacactgatgtcatgatacaaggacgtgaagatgtgagtcattgtgacatcaccagccag

SEQ ID NO: 72584 - DNA, 201 bp, Homo sapiens
aagagaacaaatataaatacagatggatcagctaaatgaaggactgtcgagtaaaaacacaaagaagatgtttgtgagtggagggggatggatctccttcyccacccagcagtgaatatcatgggaatctctctctacctgaatctacctcttataattcttaaattaagaaccattagaactcttctaaactttctaagt

SEQ ID NO: 72585 - DNA, 201 bp, Homo sapiens
acctctgtaatgtaatgcattaacttctgtagggttgcttgaatgtccttgcagtatggtagctactttcacccagggtgagcaaggtggaagctgccatrtgttttataatgtagcctaggaaatttgaactatctttttgataacacaggtcagccacatttaatatgagagagaactacacaaggcctggatagcgga

SEQ ID NO: 72586 - DNA, 201 bp, Homo sapiens
acacttaagtttgtttcctttaggcttgtgaaaatcctagtttctaatggcacagacgtgaatctgaagaatggaagtggcaaggacaggtaggaggtggkatatgactgaaattgtgctgatgttctcagaattgtgttgctaggcttgtgcccagaggggttgtgatttcaccaaaacattgtcttgagtttgacagtc

SEQ ID NO: 72587 - DNA, 201 bp, Homo sapiens
aggtgggcacgatggaatcaatcacaagcgtccttataagtgggaagaagaaacgtcagactcaggcaatacgaagatggaagtggtggttgcagtgatayacgatcatagagccaaggtgtgtggaaagccgtcagcagaaggaagaggcatggaaacggactctcccctagagcctccagaaggaaccagcctttgatt

SEQ ID NO: 72588 - DNA, 201 bp, Homo sapiens
gattgtgagatgggcagaggagcgtgtatcatccaggtgggcacgatggaatcaatcacaagcgtccttataagtgggaagaagaaacgtcagactcaggyaatacgaagatggaagtggtggttgcagtgatacacgatcatagagccaaggtgtgtggaaagccgtcagcagaaggaagaggcatggaaacggactctc

SEQ ID NO: 72589 - DNA, 201 bp, Homo sapiens
atccctgaatctaggagtatattactttacatagccaaaggggccttgggagtaaggattgtgagatgggcagaggagcgtgtatcatccaggtgggcacratggaatcaatcacaagcgtccttataagtgggaagaagaaacgtcagactcaggcaatacgaagatggaagtggtggttgcagtgatacacgatcatag

SEQ ID NO: 72590 - DNA, 201 bp, Homo sapiens
gagattgcaccactgcactccagcctgggtgacacagtgagactccgtctttccaaaaaaaaaaaaagatgtccacattcaaatccctgaatctaggagtrtattactttacatagccaaaggggccttgggagtaaggattgtgagatgggcagaggagcgtgtatcatccaggtgggcacgatggaatcaatcacaagc

SEQ ID NO: 72591 - DNA, 201 bp, Homo sapiens
gtttaagccaggtagggtaaaaggtggagctgagtttggtgactgtgcttattgtcaaatgctgcttcttccatatgttgcagtctaatgctggcgtgctrtgcgggacacctagatgttgtgaaatatctccgaagacatggcgcttcttggcaggctagagacctgggaggctgtacagctctgcactgggctgcagat

SEQ ID NO: 72592 - DNA, 201 bp, Homo sapiens
tttcacctgacattatattttggtgagttttctgtttagtacataatacattttctcgtattttaaacaactgtattctgttgtatgaatttatcataatktattgaatcagtccactgctgatggacatccagtttgtttccagacgtttgctattgtgataggctgaataaaagatgtccacaggctgggtgcggtggc

SEQ ID NO: 72593 - DNA, 201 bp, Homo sapiens
gttagtgaaaagtctcattcttgcaatgccaccaccctcttcctgtcctacaggtaaccaccatgattaatttctggtatatcattccagagatagtttaraccttgtatatagaagcaaattatgtatactgcattcctgtgtctgttctgtactttgcttttttcacctgacattatattttggtgagttttctgttta

SEQ ID NO: 72594 - DNA, 201 bp, Homo sapiens
aactttttttacactttgttttctttttactctttctagaatttattattttactttttggataagtaatatagttacaagtttcaaagataaaaaattaygaaagaatgttagtgaaaagtctcattcttgcaatgccaccaccctcttcctgtcctacaggtaaccaccatgattaatttctggtatatcattccagag

SEQ ID NO: 72595 - DNA, 201 bp, Homo sapiens
tatacatacttctaatttttaaaaattgtacagctctagcataaagagtcctacaatgggtacttatcccccatctataactttttttacactttgttttstttttactctttctagaatttattattttactttttggataagtaatatagttacaagtttcaaagataaaaaattatgaaagaatgttagtgaaaagtc

SEQ ID NO: 72596 - DNA, 201 bp, Homo sapiens
gtcctttaggagaaagaatccagtgggggctgggagtgagtgggcaaggctgtttgatgattaggtgaggtgttagctcacccacctgatccagatctgamgtcaggttttcaagtgtttattagtgatgctaactccagcactgtcatttcacccttgctcagttgtcccttcttcactgtccttgactgccccttttct

SEQ ID NO: 72597 - DNA, 201 bp, Homo sapiens
gttcatagttttcagtcacttgatcatatatcctggcattcctggtaacatatacatacttctaatttttaaaaattgtacagctctagcataaagagtcytacaatgggtacttatcccccatctataactttttttacactttgttttctttttactctttctagaatttattattttactttttggataagtaatata

SEQ ID NO: 72598 - DNA, 201 bp, Homo sapiens
atgtctgataattctaatacctgaagcacttgtgggtttgtttcttttttctgttttttattttgttcatagttttcagtcacttgatcatatatcctggsattcctggtaacatatacatacttctaatttttaaaaattgtacagctctagcataaagagtcctacaatgggtacttatcccccatctataactttttt

SEQ ID NO: 72599 - DNA, 201 bp, Homo sapiens
catatttaggatcctaaaaccaatatcctaaaatatgtatattagcagatgatgacaaaaacaccagaatttttatcaaagagaaagtagaaagtatatgrgttaatattgtaaggattaggatacacctgtcaaattactctaggttggcttagaaacaaagcaaaacaaattgggtcccatccactattttttggcatt

SEQ ID NO: 72600 - DNA, 201 bp, Homo sapiens
ttcatgcaggcctcctgtagctcagaaccttgttttgtatgccacatagcatttagctctgttgggcttattttacttgtttacttgtttgcttagtttgtttaccttgttgtttacttgtttacttcttgttcctttcctgcctcctcacccagtattaaactcagtgagagacaaataagacttctgcctgcttaacgc

SEQ ID NO: 72601 - DNA, 201 bp, Homo sapiens
ttttggagaagcctttagtcagacttttcagacagagtttgtgtaatgaatctggttgttctgtattttacctgtaggtctcctgcctaaaattgataagyattagtaagtataagtgtgtatatatattattactgtcttgttccagaaaggatgtaaagctgcttacaacaatacataaaagtaagaaaaatgaatgct

SEQ ID NO: 72602 - DNA, 201 bp, Homo sapiens
tgatgctggggccaatgtgaatgtgaaggacagaaatggaaagacgccccttatggtaggtcctcctcccgaaaataggcagttttctacgtggaattaakgtcagagctttttctgtaattagacaattcttgtgagttcagccctgcaccagcccttgggtttgactgtgtgtgtgtgttccctgtcggcttgttcata

SEQ ID NO: 72603 - DNA, 201 bp, Homo sapiens
tttcatgcaggcctcctgtagctcagaaccttgttttgtatgccacatagcatttagctctgttgggcttattttacttgtttacttgtttgcttagtttgtttaccttgttgtttacttgtttacttcttgttcctttcctgcctcctcacccagtattaaactcagtgagagacaaataagacttctgcctgcttaacg

SEQ ID NO: 72604 - DNA, 201 bp, Homo sapiens
acctggtgtcggcccaaaggcacctgtaggaagtgactggagaccctggttgggaggtcccggccagtgaggaggaacgggattgggacccacttaaaaaagtggccacattttgggagagcagttgtgctgtgctaggggtccgcttcagcccctgatcgcctcggatactatgaggctcaaaggctggaacagctaagg

SEQ ID NO: 72605 - DNA, 201 bp, Homo sapiens
gacctggtgtcggcccaaaggcacctgtaggaagtgactggagaccctggttgggaggtcccggccagtgaggaggaacgggattgggacccacttaaaaaagtggccacattttgggagagcagttgtgctgtgctaggggtccgcttcagcccctgatcgcctcggatactatgaggctcaaaggctggaacagctaag

SEQ ID NO: 72606 - DNA, 201 bp, Homo sapiens
cggctaggctcaagtgatcctcccacctcagcctcccgaatagctgggtctataggtgtgctgccatgcccagctaatttttgtattttttataaagacakgattttgccttgttgcccaggctggtctcaaactcctgagctcaggccatcctctcactcgggcctcccaaagtactaggattataggcatgaccaccac

SEQ ID NO: 72607 - DNA, 201 bp, Homo sapiens
aggttctgttagatgttagaattatgatgttagagttgtctccagatttcacggaggcacctctttcctggacgtgccagactcttctgcgccctgactcrccgcagtgagagtacctagaccatgactttcccaggtgttgtgtgttctttcaaccctactgggaagtccctttctcagactgcctgggagacgtctgcc

SEQ ID NO: 72608 - DNA, 201 bp, Homo sapiens
ggacctggtgtcggcccaaaggcacctgtaggaagtgactggagaccctggttgggaggtcccggccagtgaggaggaacgggattgggacccacttaaaaaagtggccacattttgggagagcagttgtgctgtgctaggggtccgcttcagcccctgatcgcctcggatactatgaggctcaaaggctggaacagctaa

SEQ ID NO: 72609 - DNA, 201 bp, Homo sapiens
aagacaggattttgccttgttgcccaggctggtctcaaactcctgagctcaggccatcctctcactcgggcctcccaaagtactaggattataggcatgascaccacacctggccagtacatcttaaaaatgatttctgatccacgttgaataatgatggcctataaatattttttcttgcacttgccttgttgggttttg

SEQ ID NO: 72610 - DNA, 201 bp, Homo sapiens
tcaatgtgcttagtctttttcttggctctgctggtgctacacccgagaagtcatttagatttggtgtctgaagtaactttgtgatgcaaaaacaggatcaktgaacgttcagtgtttgattttaccttgaaatttcacattttaacaaaggacagaaacatcaagtgaagaaagtctttgtaaatgtttttcagttttcaa

SEQ ID NO: 72611 - DNA, 201 bp, Homo sapiens
tcttttctggatgttttcactgggctgatgctttatgtagggtctttatttgaagcttacttgttgtctctggtttcagaggggggtatgttaatgaggtrtttttggtattgaagctttggggtgtgatccagtaggtggcgcttaggtgaattggtcagttgctagactcttgtttggttgcgtggctcccctgtttcc

SEQ ID NO: 72612 - DNA, 201 bp, Homo sapiens
agctgtacagattctcttctaccacttcccatcctgttcaaggggagaggaactagactctaactctggcgggggaggaacatgttcctgcggggatggtrgagactgtggaggtcagcttgacttccagctcatttggcttcttttaggtgaagagaaatgtgtttctggcaaagatgatgtcagttaggagactgaatc

SEQ ID NO: 72613 - DNA, 201 bp, Homo sapiens
acttctgggcatcttaaggcccagacccagagctgtacagattctcttctaccacttcccatcctgttcaaggggagaggaactagactctaactctggcrggggaggaacatgttcctgcggggatggtggagactgtggaggtcagcttgacttccagctcatttggcttcttttaggtgaagagaaatgtgtttctgg

SEQ ID NO: 72614 - DNA, 201 bp, Homo sapiens
ctcccaaagtgctgggattactggagtgagctactgtgcccggtcataaaattatcatattgcattatttagctctgtcagacccgttaggttttttttttatgctggctattctatccttcagcttctatatcattttactgtgattgttcttttccttagatttggtttcaacatcctcctgaatctcagtgatctttg

SEQ ID NO: 72615 - DNA, 201 bp, Homo sapiens
ggacagcaggagactggctgggctttttcatctcctttgtggtctggatcttccactgactgtcttactaggtggcctctttctctaacagggaagttgarcttctcctccctgcttccaagggaggagaagcagaaacttctgggcatcttaaggcccagacccagagctgtacagattctcttctaccacttcccatcc

SEQ ID NO: 72616 - DNA, 201 bp, Homo sapiens
aaagctggtggcctgcccctccccctgggagctccttcttagggtggtgcaatgccgctactggtagctggctggaattccaagccagtgggtcttatctsgtgaggtgcagtggaagtgggggctgttgctgcttagctgcctggattcatcctctttcctaagtgtatgtacaggagtctaacctctcactttgccaga

SEQ ID NO: 72617 - DNA, 201 bp, Homo sapiens
caacatttgcttacctgaaaaggatcttgtttctccttcacttaggaagcttagtttggcaggatatgaaattattggttgaagattttttttttttttttaaagaatgttgaatataggcctctaatctcttctggcttgtagggtttcactgttagcctaaggggatccctttgtaagtgacctgccctttctctctag

SEQ ID NO: 72618 - DNA, 201 bp, Homo sapiens
tcttagggtggtgcaatgccgctactggtagctggctggaattccaagccagtgggtcttatctcgtgaggtgcagtggaagtgggggctgttgctgcttrgctgcctggattcatcctctttcctaagtgtatgtacaggagtctaacctctcactttgccagagctacggctacttttgctggaaagcctgagtagcta

SEQ ID NO: 72619 - DNA, 201 bp, Homo sapiens
tatgtacaggagtctaacctctcactttgccagagctacggctacttttgctggaaagcctgagtagctaaggctccagggtctccacgcgtgcctgagcrgctgctctgccaagactccacgctgctctgtcagaatgaagactgaaggcactggtagagaggggtttacgtggagagctcctgacctgaggtttgcaaa

SEQ ID NO: 72620 - DNA, 201 bp, Homo sapiens
gtttacgtggagagctcctgacctgaggtttgcaaagatctgtgggagaagcatggtttctgggtcgctcattcggtcattgcttctctgggcaggggagkatcccctggctccgtgctgacccccggggggccattgtcctgtcttgcttttctttgttctctgtgggtcaggttgtttccttgattagtcccagtgcga

SEQ ID NO: 72621 - DNA, 201 bp, Homo sapiens
aataatcatgaagagttagttcagttacttcttgacaaaggggcagatgcaagtgtaaaaaatgaggtaaatgagtccatctttatgtaaagattttcctyggagggggagaaaacatttataagcatgtaaaatttttgttgtttcctgtttcagttcggcaaaggtgtcctagaaatggccagagtttttgacagacag

SEQ ID NO: 72622 - DNA, 201 bp, Homo sapiens
tagcggaagtgaaaatcactgggggccatcttggaggctggctgccacagagattagcaactggaatactgttttcaaagaaacagctttggctttttatrttttctctattatgtctttgtttttttttcattgatttcacttttatccttattatttccatcattttaatttcattcggcttaatttgctgggattttt

SEQ ID NO: 72623 - DNA, 201 bp, Homo sapiens
ccgttctgtttccacacccttagttttctattacttttaggaatgacctttgttaactaagtcattaaaatccaataaacataaactcttcagaccccacwgctggatcatactcttggcagcaagcagaggaaggcaggggctaccactgttttacagaataatagtaagtcaatgatccaagaaatgacttcccaggga

SEQ ID NO: 72624 - DNA, 201 bp, Homo sapiens
ccgccagggagggcgcgaccgcctgaccgggcttcaggagcagtgtcctcagccggtgacctggccgctaccctcgctcagtgtccccggcgacgcgcggrtcctcacgcgctccctcacttcctgcggcttttggtccctcccgctcgccgtccctttagttctgcccacttcgcctccgggttgtcagggcaaccgtag

SEQ ID NO: 72625 - DNA, 201 bp, Homo sapiens
aactatctttttgataacacaggtcagccacatttaatatgagagagaactacacaaggcctggatagcggaagtgaaaatcactgggggccatcttggakgctggctgccacagagattagcaactggaatactgttttcaaagaaacagctttggctttttatattttctctattatgtctttgtttttttttcattga

SEQ ID NO: 72626 - DNA, 201 bp, Homo sapiens
gcctaggaaatttgaactatctttttgataacacaggtcagccacatttaatatgagagagaactacacaaggcctggatagcggaagtgaaaatcactgsgggccatcttggaggctggctgccacagagattagcaactggaatactgttttcaaagaaacagctttggctttttatattttctctattatgtctttgt

SEQ ID NO: 72627 - DNA, 201 bp, Homo sapiens
ttttataatgtagcctaggaaatttgaactatctttttgataacacaggtcagccacatttaatatgagagagaactacacaaggcctggatagcggaagygaaaatcactgggggccatcttggaggctggctgccacagagattagcaactggaatactgttttcaaagaaacagctttggctttttatattttctcta

SEQ ID NO: 72628 - DNA, 201 bp, Homo sapiens
atgtgttttataatgtagcctaggaaatttgaactatctttttgataacacaggtcagccacatttaatatgagagagaactacacaaggcctggatagcrgaagtgaaaatcactgggggccatcttggaggctggctgccacagagattagcaactggaatactgttttcaaagaaacagctttggctttttatatttt

SEQ ID NO: 72629 - DNA, 201 bp, Homo sapiens
ctgtctgcctcggcctcccaaagggctgggattacaggtgtgagccactgtgcctggccttttctcatatgtttatagcagcacaatctgcaactgaaaawatatggaatcagttcaaatgcccatcagtgaacgaatggataaagaaaatgtggtatatatgtaccatggaatactactcagccataaaaaggaacaaaa

SEQ ID NO: 72630 - DNA, 201 bp, Homo sapiens
ttccctcttgtttcccaggctggagtgcagtggtgcgctctcggctcactacaacctctgcctcctgggttcaagcaattctcctgcctcagcctcccagktagctgagattataggcatgcgccaccacacgcagctaattttgtatttttagtagagataaggtttctgcatgttggtcaggctggtctcgaactcctc

SEQ ID NO: 72631 - DNA, 201 bp, Homo sapiens
acagaaaatacgagagaataaatatgttttttctccctttttttttttttttttgagacaagagtttccctcttgtttcccaggctggagtgcagtggtgygctctcggctcactacaacctctgcctcctgggttcaagcaattctcctgcctcagcctcccaggtagctgagattataggcatgcgccaccacacgcag

SEQ ID NO: 72632 - DNA, 201 bp, Homo sapiens
cccacagaaaatacgagagaataaatatgttttttctccctttttttttttttttttgagacaagagtttccctcttgtttcccaggctggagtgcagtgrtgcgctctcggctcactacaacctctgcctcctgggttcaagcaattctcctgcctcagcctcccaggtagctgagattataggcatgcgccaccacacg

SEQ ID NO: 72633 - DNA, 201 bp, Homo sapiens
tcgtttgccacagctgtttctcttaaaagttctctgataagtcattgccaccactacttccaaatagcatatgttaactttgagttaattttacataaacytgggttaatttacaaaattttggcaccaacaacatggttaggcaaggcagcatggatgggtattggaatctgtcaatctgggttgctgtataccagctct

SEQ ID NO: 72634 - DNA, 201 bp, Homo sapiens
accttgcctgcaaccttgtgagagcctatgcagtgaacccagttgagctgtgccccaattcctgacccacagaaaatacgagagaataaatatgttttttytccctttttttttttttttttgagacaagagtttccctcttgtttcccaggctggagtgcagtggtgcgctctcggctcactacaacctctgcctcctgg

SEQ ID NO: 72635 - DNA, 201 bp, Homo sapiens
ggtgctttagaaattctggcttacttgtatttttgctggccttctaatgatttcactcatcaatcagaagatatttgtgtccaccttcctgcttcctctcyggtgatcttgtctattcttggccattttagagttgacttagcagccttcacaaaactggttggaatttccactgggattaaattgataggtcatttttgg

SEQ ID NO: 72636 - DNA, 201 bp, Homo sapiens
agcagaaacaggcatgtgtttgctcatgatctgtaatttggctagggtgttgatggcttgtttctgccccatgtggtcttggccgttgcagctctcttggkgctggaagaaccaaatggcttcacccatgtgtgatgcatcagctgggatggccaggacagcaggagactggctgggctttttcatctcctttgtggtctg

SEQ ID NO: 72637 - DNA, 201 bp, Homo sapiens
aaaagtttctgtaatgccattggcgttatttcttcattgtctttcctacagtttcttttttgttgatacatactatctcagttatctgctgcatgacaaascagccccagacttagtggttgacagcagaaacaggcatgtgtttgctcatgatctgtaatttggctagggtgttgatggcttgtttctgccccatgtggt

SEQ ID NO: 72638 - DNA, 201 bp, Homo sapiens
ccctggctccgtgctgacccccggggggccattgtcctgtcttgcttttctttgttctctgtgggtcaggttgtttccttgattagtcccagtgcgagtayctggctgtttcagttgaaggtgttgtattcactcgccccttctgttcctctccgtgagagtcaggtacaccagctgcttctagtcagccatcttggccac

SEQ ID NO: 72639 - DNA, 201 bp, Homo sapiens
gttgtttccttgattagtcccagtgcgagtatctggctgtttcagttgaaggtgttgtattcactcgccccttctgttcctctccgtgagagtcaggtacmccagctgcttctagtcagccatcttggccactcactcttgtgtgtatttatgctctgatttctgcagaagtttccaggggtgggatggtgagacagggat

SEQ ID NO: 72640 - DNA, 201 bp, Homo sapiens
tcatctatgttccacatacttggatcagatagagcatttgtctcttggctttgttagtcactgaaggattacagaagcaaactgagttccagcaggtcaartacaaccttattagtttgatatgttaagcagccctttggaagggtcagtgggggtggtatgatattgatgggcatggtacaatatatgcttgttgaagac

SEQ ID NO: 72641 - DNA, 201 bp, Homo sapiens
gtcactgaaggattacagaagcaaactgagttccagcaggtcaaatacaaccttattagtttgatatgttaagcagccctttggaagggtcagtgggggtrgtatgatattgatgggcatggtacaatatatgcttgttgaagactgtggtagctcacacatcagctgaattttgtatctctttagcttttcaggggttct

SEQ ID NO: 72642 - DNA, 201 bp, Homo sapiens
acaatatatgcttgttgaagactgtggtagctcacacatcagctgaattttgtatctctttagcttttcaggggttctttaagcaacagggaggtatgctyatatgtgtgccttatgctcagaaaaatagctcgatcaccaagcagctgtaatccactcgactggtctctcttccttatggaaactgggtcctgaagttcg

SEQ ID NO: 72643 - DNA, 201 bp, Homo sapiens
agcagctgtaatccactcgactggtctctcttccttatggaaactgggtcctgaagttcggtgtcattcttttttttagaaatcatgccaccctcaaagcytcatccacctgtcgtgggcaaagtgactcatcacagcattgaattatactgggatctggaaaagaaagccaaacgccaaggacctcaagagcagtggttc

SEQ ID NO: 72644 - DNA, 201 bp, Homo sapiens
gttgtgttcactgacgtggaatggccccgcatggtctaccctggctagcttctctgatctcatgtcataccattgtccccttgtcaactctcttataccaygctggctgcctctcagcctggacaggccaagctggttcccatcgcaggatcttgctcgttgctgtggtcttgaatacatttccttctgtttttatacagc

SEQ ID NO: 72645 - DNA, 201 bp, Homo sapiens
ataccattgtccccttgtcaactctcttataccatgctggctgcctctcagcctggacaggccaagctggttcccatcgcaggatcttgctcgttgctgtkgtcttgaatacatttccttctgtttttatacagctggttccttcacaccatgccaatctcagatgaaacatccccccgcccccagaaggccatctgaagt

SEQ ID NO: 72646 - DNA, 201 bp, Homo sapiens
tccccccgcccccagaaggccatctgaagtagccatcctttcatgcaggcctcctgtagctcagaaccttgttttgtatgccacatagcatttagctctgytgggcttattttacttgtttacttgtttgcttagtttgtttaccttgttgtttacttgtttacttcttgttcctttcctgcctcctcacccagtattaaa

SEQ ID NO: 72647 - DNA, 201 bp, Homo sapiens
tttcccaacctgtctgctggttacttttcagagtacttggatcattgctatttatattttgtccagagtttcaaattgtgatcagtggaaatgacaggccrtagcatacatacgccatcctggccagcatcacaggtggtcagtacatctttctgttgttgttttgagacagggtctcactctgttgcccaggctggagca

SEQ ID NO: 72648 - DNA, 201 bp, Homo sapiens
tcttcttccactgctacctggaagctggagtgacctttcaaaatatacatcaaatcagatcatgtcactctcctgccaaaagccctccaaagtccttacgktgatctagctgcctcttcaaactcatcacacatctgatcttagatgtattatgcttcaagcacattggtcttcttgtagtccctcaaacaagcttctttc

SEQ ID NO: 72649 - DNA, 201 bp, Homo sapiens
cgtttgccacagctgtttctcttaaaagttctctgataagtcattgccaccactacttccaaatagcatatgttaactttgagttaattttacataaaccygggttaatttacaaaattttggcaccaacaacatggttaggcaaggcagcatggatgggtattggaatctgtcaatctgggttgctgtataccagctctg

SEQ ID NO: 72650 - DNA, 201 bp, Homo sapiens
agctgacaccttgcctgcaaccttgtgagagcctatgcagtgaacccagttgagctgtgccccaattcctgacccacagaaaatacgagagaataaatatsttttttctccctttttttttttttttttgagacaagagtttccctcttgtttcccaggctggagtgcagtggtgcgctctcggctcactacaacctctgc

SEQ ID NO: 72651 - DNA, 201 bp, Homo sapiens
cagctgacaccttgcctgcaaccttgtgagagcctatgcagtgaacccagttgagctgtgccccaattcctgacccacagaaaatacgagagaataaataygttttttctccctttttttttttttttttgagacaagagtttccctcttgtttcccaggctggagtgcagtggtgcgctctcggctcactacaacctctg

SEQ ID NO: 72652 - DNA, 201 bp, Homo sapiens
aacccagctcagctgacaccttgcctgcaaccttgtgagagcctatgcagtgaacccagttgagctgtgccccaattcctgacccacagaaaatacgagasaataaatatgttttttctccctttttttttttttttttgagacaagagtttccctcttgtttcccaggctggagtgcagtggtgcgctctcggctcacta

SEQ ID NO: 72653 - DNA, 201 bp, Homo sapiens
gtggtgtctaggacctgagggtggcctccagccaatacccaataaaaaacatagctacataatcatacagacataaggaaatgaattttgtcaacaacctsaatgagcttgaacccagctcagctgacaccttgcctgcaaccttgtgagagcctatgcagtgaacccagttgagctgtgccccaattcctgacccacaga

SEQ ID NO: 72654 - DNA, 201 bp, Homo sapiens
ttgctgatttgaggaagtgtgtgaccatattgagaaagcccaacagcaggtggtgtctaggacctgagggtggcctccagccaatacccaataaaaaacakagctacataatcatacagacataaggaaatgaattttgtcaacaacctgaatgagcttgaacccagctcagctgacaccttgcctgcaaccttgtgagag

SEQ ID NO: 72655 - DNA, 201 bp, Homo sapiens
tgtgtgtatgtgtgtgtgtgtgtgtgcacagaagaaaggagagggaagaggagaggaggaggaggagagagacatacattaggatatgagatagacatatwgctagcatgcacgcaagattctccttgctgatttgaggaagtgtgtgaccatattgagaaagcccaacagcaggtggtgtctaggacctgagggtggcct

SEQ ID NO: 72656 - DNA, 201 bp, Homo sapiens
tgacgtaatattgcaaatgtgatgggttgttactcctgggatgtgtgtgtgtgtgtgtgtgtgtatgtgtgtgtgtgtgtgtgcacagaagaaaggagagrgaagaggagaggaggaggaggagagagacatacattaggatatgagatagacatattgctagcatgcacgcaagattctccttgctgatttgaggaagtg

SEQ ID NO: 72657 - DNA, 201 bp, Homo sapiens
tctgtgacttgtttctaactgacgtaatattgcaaatgtgatgggttgttactcctgggatgtgtgtgtgtgtgtgtgtgtgtatgtgtgtgtgtgtgtgygcacagaagaaaggagagggaagaggagaggaggaggaggagagagacatacattaggatatgagatagacatattgctagcatgcacgcaagattctcc

SEQ ID NO: 72658 - DNA, 201 bp, Homo sapiens
atgatctcttccttttttagtgtggatgggatcactgctcagccttttggatgaaatcgagtgaacgtgagtaggatctgtgacttgtttctaactgacgyaatattgcaaatgtgatgggttgttactcctgggatgtgtgtgtgtgtgtgtgtgtgtatgtgtgtgtgtgtgtgtgcacagaagaaaggagagggaaga

SEQ ID NO: 72659 - DNA, 201 bp, Homo sapiens
atgatctcaatgtcctggtgttgtactctgtatgatctcttccttttttagtgtggatgggatcactgctcagccttttggatgaaatcgagtgaacgtgrgtaggatctgtgacttgtttctaactgacgtaatattgcaaatgtgatgggttgttactcctgggatgtgtgtgtgtgtgtgtgtgtgtatgtgtgtgtg

SEQ ID NO: 72660 - DNA, 201 bp, Homo sapiens
gttaactttgagttaattttacataaacctgggttaatttacaaaattttggcaccaacaacatggttaggcaaggcagcatggatgggtattggaatctrtcaatctgggttgctgtataccagctctgggactgggggcaagttgtagcagccctgagcctcctgcttcacctgtatcaggggaggctgagacccacct

SEQ ID NO: 72661 - DNA, 201 bp, Homo sapiens
attgatataaattgttaaaaataatgatcgtagatagataatgtatcagagtttgggctcagccgctgtagctgctgttgacccagaggaaccactgggakcctcacatctcagggcagcacatcgtttgcagcaatggttggttctgtacaaccttttatgaaattaggtgaggcccttgattagaatttgttttttaaa

SEQ ID NO: 72662 - DNA, 201 bp, Homo sapiens
atttatatggctcatcagaattcactagattggttaagcaggaaatttacagagatttttttctttgctgtaaatgtttttctaaattgaaaaacttctawtactgtcttctggaatactagaaataagtgcaagtgattgtttttggcaggaggccacataaacatttctgcttctctgtgacttatgggtagcattgat

SEQ ID NO: 72663 - DNA, 201 bp, Homo sapiens
ttggcctgtacatgttgcttttattttttttctggacttaagatatagaccaaaccttgacatttctggcctttgagtctttcacaactgtgattataatrcattagctcttctagaagttagaagtgactttggattaagtctttcataaggtggctaaatgaatttatatggctcatcagaattcactagattggttaa

SEQ ID NO: 72664 - DNA, 201 bp, Homo sapiens
gaatgggaaagccggattgcggtaacatggacccctgggagaggttctggagtcttggcctggcagacacctgggaggtgtagggttggggcctggcatarcgcagcctgctcctataggcatccctggtgtcctaggcagctgtcacctgcaggggtagcatagtgggagggcagggcataggtgctgatggctgtggag

SEQ ID NO: 72665 - DNA, 201 bp, Homo sapiens
cctgcaacttccttgttatatgtcacttgttatagtaaagaatgctatattacatgaactctaaaatgtgctagattgtaaggagctgtctgtgctccagygccagagaaagaatctcaagaatcttgccaattttaatcaaaggatactatagattgtaaaatgcctcttgcattccaagatgttagatgtgaaatacat

SEQ ID NO: 72666 - DNA, 201 bp, Homo sapiens; identical to SEQ ID NO: 59688

SEQ ID NO: 72667 - DNA, 201 bp, Homo sapiens; identical to SEQ ID NO: 59664

SEQ ID NO: 72668 - DNA, 201 bp, Homo sapiens; identical to SEQ ID NO: 59690

SEQ ID NO: 72669 - DNA, 201 bp, Homo sapiens
ggagtggagcaccagcaactgttagacctcgcccagaagcacctcggtggcatcccatggacatatgcagaggacgctgtgcccactcttactccatgccrcttcactggcagtgaggtatgctgccttttgggcaggagtagtgctcagctgggggcctgtgggaggacccccatgtgcatggttatcctggtgactcca

SEQ ID NO: 72670 - DNA, 201 bp, Homo sapiens
caccactgggactggttacacaggatgctgtccctctggtacaggtctgtcttagccccacctggttctaggatactgagttcatgggctggtaggggatrtaagctcctggccttgttccttgtggccttgcccttgggagagccagccattagttgtgtgttgatgcatgcctgataacaaaccaagaagtgccttgaa

SEQ ID NO: 72671 - DNA, 201 bp, Homo sapiens
acaaggcccctcgaatggtgctggcagcagctggaggtgagtgatggaatcactgaagtcctgggtagtggggtcccagccttggttatcaaagccgaggkcctggttcccaccataggggacctttcaccccaggggactctgctcccaccctaaccttgaggggaatgaccttcctcctgtgctctctgaggtgggata

SEQ ID NO: 72672 - DNA, 201 bp, Homo sapiens
aaagccgaggtcctggttcccaccataggggacctttcaccccaggggactctgctcccaccctaaccttgaggggaatgaccttcctcctgtgctctctraggtgggataggattctaccctgccgccaccactgggactggttacacaggatgctgtccctctggtacaggtctgtcttagccccacctggttctagga

SEQ ID NO: 72673 - DNA, 201 bp, Homo sapiens
ggaagaggcggggacagagggcagggaagcagaggacagctacctaggagcccctggctgaccacagaatcatattacccttagcgtatggctttgcagcygggcaactaggggtgggcagcaggagatgccaggcctggggattttgtgctgtcgttggtctgcagtggtccacctggcacctaaacatgtcctccttgc

SEQ ID NO: 72674 - DNA, 201 bp, Homo sapiens
acagtctaaaccaatagtcccttccttaatgatgaaaggataaaatcattgccagaacaaaggcagcgtgtaatttttagaaaggaaaaaataagttgttrtttgcaaatgatatgttgtatgcttagacaaaaacaaataattaactgaaaattgagagtgaatttaaggatttgtatgctggtgagaccaggtaaatgt

SEQ ID NO: 72675 - DNA, 201 bp, Homo sapiens
tccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgca

SEQ ID NO: 72676 - DNA, 201 bp, Homo sapiens
tatgagcctgtcctgaagtcaggcatgaggcaagggcagacaagggttgccctctgggccctggaggggtgggtggcagagacaggggaagggggttgggsagtgtgctagggcccactcttcggagaaaccatgcctctcctagtctgcctcctcagtcccattcatgcatgtaccccaactcactccagtgtggtagag

SEQ ID NO: 72677 - DNA, 201 bp, Homo sapiens
ggcgtggacccgggaggtggagcttgcagttagctgagattgcaccactgtgctccagcctgggcaacagagcgagactccgtctcaaaaaaaaaaaaaaaggccaatgcaactggtggcaccacagagccctcctcttgtggaggtgaggaggcaagatccaaggagtcctagggtatacgtttgtaacattatttgcaa

SEQ ID NO: 72678 - DNA, 201 bp, Homo sapiens
gccaggctggtctcgaactgctgacctcgtaatccacctgccttggcctcccaaagtgctgggattacaggtataagccaccgcgcccagcctgtggtgcrtgtttcacagcaaccaggaggctgtcaagaaaattaatattaccttattgggtgccaaggcaacactgtttggtgttcagagctgattaaaaacaacaac

SEQ ID NO: 72679 - DNA, 201 bp, Homo sapiens; identical to SEQ ID NO: 59666

SEQ ID NO: 72680 - DNA, 201 bp, Homo sapiens
aaagtacttaggaaagtagatgtgaaaaacttaaatcagctgtgaacaaatagtaaattaaaagactagaccgtgtgaccaagtggggtgagtggtacgtrtttcttttacattttttttttttttttgagatggagtctctctgtcacccaggctggagtgcagtggcacgatcttggctcactacatcctctgcctctt

SEQ ID NO: 72681 - DNA, 201 bp, Homo sapiens
ctctactaaaaatacaaaaattaggctagacgcggtggctcacgcctgtaatcccagcactttgggaggccgaggcgggcgaatcacaaggtcaggagatygagaccatcctggctaacacggtgaaaccccgtctctactaaaaatacaaaaaattagccgggcgtggtggcgggcgcctgtagttccagctactcggga

SEQ ID NO: 72682 - DNA, 201 bp, Homo sapiens
tgtgctcatacatgggcccagggaatactcacacaggtacactcacagatttacatgtacacacttgggcacaacacacacataaccacccacacgtgtgkattcatgcacatatgcatctcttcaccccatttgcactctcttatacacacacacacacacgcacacacacaggctcccaggctcttccctcagcatctc

SEQ ID NO: 72683 - DNA, 201 bp, Homo sapiens
agaagtctcatgtcattctgatttgctgatcttcctaaaagcttcatctcttagagggagctgagagtttctcatgccccttccgcttgggaggcctttarggtcttcaaggtgatgtggtttgtggtgggtcttctctccaccatacatggtcctagggggccccttttcatcataacactcttgttctccaggtcaggg

SEQ ID NO: 72684 - DNA, 201 bp, Homo sapiens
cacacacacacaaacttatacacatgggtgcatgcacacacatcctgtgtgcacacatgtgggcacactcactcatacctgtgcccatttagtcacatacygcacacaggggttgtgcacgctcgtgtgtgtgcacctgtgctcatacatgggcccagggaatactcacacaggtacactcacagatttacatgtacacac

SEQ ID NO: 72685 - DNA, 201 bp, Homo sapiens
ccccaggataagctctctcctgtgtatttggagcatgttcttggtgtgtgattgctggtgcgattggctttgcattgacatctcctagatgctgctgggtragtcgttcacacttctgctgttactctggagatagaaatatgtatatgctaccgccccaccctcaacaactttcagacttgaactgagtcctttcttcaa

SEQ ID NO: 72686 - DNA, 201 bp, Homo sapiens
gagctggtggccaggggtgccccttcaggcctgctctcacagtgaaaccacttcaagacagggcaggaagttaccttcctggtgcacacaccgaagtgctygagggagaggctgccgccccctctccccttccctggctgtggacactggcagccaatggggaggcggcctctcccctgttgctgcccgtgtccacacagg

SEQ ID NO: 72687 - DNA, 201 bp, Homo sapiens
tgggttttctctggagtctagtccccagctcctcagggcactaggggctggtggactgagggatgtactgcacctcctccactcccacaggcacgcccccrcttgataaaatttaaagccacacctgagggcttgggaggcttttacctttcccatcattggcctccgagctcagacctggaggaactctgagggcaggtg

SEQ ID NO: 72688 - DNA, 201 bp, Homo sapiens
tctgagtcagggattgatgcatcagctccaagccaacccccgttacaggtgagaggaagctgaggcccaatgggaaggtctcatagctcctgaggcagggmttgtgtttctccaggctctaagtgtggaactgaaatgtggctctggcctgagctgaggggctcgtgccatcacggtgtctcagggtgttggggtaggctg

SEQ ID NO: 72689 - DNA, 201 bp, Homo sapiens
ggcgggagacagatggggaaccggggacaggtgaggttgccgtgactggggaggctgctggggacaggtgaggcggtcgtgacagtggtgggccagagacrggtgtggcagagcagggggcggggacaggtgtgtgggggcatatcggcttggcggtggctaggtctggccaccatcacctcggggagggctctggccccc

SEQ ID NO: 72690 - DNA, 201 bp, Homo sapiens
cagatgccacctgtccctgagagaagttagcgtccctggccctggccggtggtctctcatccttgtgtgctgctctgctaagagatgtccaaggcggagcyggggcaagatccttccagactcatctgtcagagccccaagccctttagacccagagcccaaggaccatgcctttgggacattaggactgcagcctttgct

SEQ ID NO: 72691 - DNA, 201 bp, Homo sapiens
agatgccacctgtccctgagagaagttagcgtccctggccctggccggtggtctctcatccttgtgtgctgctctgctaagagatgtccaaggcggagccrgggcaagatccttccagactcatctgtcagagccccaagccctttagacccagagcccaaggaccatgcctttgggacattaggactgcagcctttgctt

SEQ ID NO: 72692 - DNA, 201 bp, Homo sapiens
gtgtattctaccatcctgtttgctcagtgtcagggtcctgtgggctcagagccacaggtgcagccgtgcacccagcccgcttagtccacgtgctctgtttygagagctgcaatgtgttccctccttgttgtgcctcagttggcaatttcttatggctggaatttcccagtgttttgctatggtaagcagagctgttgtgat

SEQ ID NO: 72693 - DNA, 201 bp, Homo sapiens
cctaaagggctcagataccacagggcttcttctgctgtaagtgatcagtctagagagaagagtgtcattagtgaggtgaccaggattgagggtgaggggtkttcccggtggccatggagatgccttggggaaaggactcattgaggaagtgactttttagctgggctttgtatgatgaaaagaagttcaccacagggaggg

SEQ ID NO: 72694 - DNA, 201 bp, Homo sapiens
gagataggtaatttattgccttgttttgcacccaggcctgatttgctgccctgcctgcccaccttgtgctgcgcatgtgggtggaaggcgggaagggaaawgccaccaaatgccatgggaggaggctggagctgtctctgggaaaataggagatgtggagagggggtgcagatccccagtcctgaggttttgggagtccct

SEQ ID NO: 72695 - DNA, 201 bp, Homo sapiens
atgacgaagagaatagagaaggcctattctctattatttggcctggggttgggtcaaggtcagggttggtaggggttgctgttgctgtgaaagctgagcckctccttccctccagagttcaatgttggccagtatcgccgggacgtggtcaagacctacaaatcttttgaattttttctccccgacaatgaagagggcctg

SEQ ID NO: 72696 - DNA, 201 bp, Homo sapiens
cccgccaggggcaagacctacatctccaagaagctgactcgatacctgaactggattggtgtgcccactcggggtgaggcttggccccagctgtctaaggrgagctttgtggggcatgacgaagagaatagagaaggcctattctctattatttggcctggggttgggtcaaggtcagggttggtaggggttgctgttgct

SEQ ID NO: 72697 - DNA, 201 bp, Homo sapiens
tttgatgccacaaacaccacccgagaacggagagcgaccatctttaattttggagaacagaatggctacaaggtgaggcctccttggctcctctccttggyggaactgtggcatgtcccctgccctccagggctcctttcaccgcctgcttatgcatgaggggcatggggctggcatggctcctgagtgtaatttgggatg

SEQ ID NO: 72698 - DNA, 201 bp, Homo sapiens
tgtcatctgaggtgagaccaccgaggccttttctctctgtgtacagaggggagttaggagttgctggactggatgcattacgaggactggggacagggtaragggacatccagggatcagggcatgagtgggggcaaccccccggcctctgccctggcatggtctccgcatgggctgaggtgtagctgattggctgccaca

SEQ ID NO: 72699 - DNA, 201 bp, Homo sapiens
ccaggctgtgatgcgctgcctgctggcctacttcctcgacaaggcagcaggtgtgggctgtgccccgggggaggtgggaaggttgtgtgagaaggtaggcmctgtcaccaggcatttctggtgtgctagccatccccctctgtgtctacagaacagctgccctacctcaagtgtccgctgcacacagtcctgaagctgact

SEQ ID NO: 72700 - DNA, 201 bp, Homo sapiens
accacctttcccaatttgctttttttctttgagacggagtctcgctttgtcacccaggctggagtgcaatggcgtgatctaggctcactacaacctccacytcccgggttcagatgattctcttgcctctgcctcccgagtagctaggattacaggcgcctgccaccatgcccagctaatttttgtatttttagtagagac

SEQ ID NO: 72701 - DNA, 201 bp, Homo sapiens
ccatcatagctgttttgaagtgtacgtttcaggagtatgaagtacatttacattgttatgcaactctcaccaccatgcatctccagaactcttttaatctkgtaaaacagaaactctgtacccactgaacaataactcaagccagatgtgctggctcacacctatagtcccaggtacttgggaggctgaggtgggaggatt

SEQ ID NO: 72702 - DNA, 201 bp, Homo sapiens
atgtccccatctttttttttttttttttgagacagagtctcattctcttccccaggctggagtgcagtggcgtaatcttggctcactgcaatctccacctyttgggtacatgcgattctcctgcttcagcctcctgagtagctgggactacaggcgtgcgccaccacgcccaactaatttttgtatttttagtagagacgg

SEQ ID NO: 72703 - DNA, 201 bp, Homo sapiens
ctgaatggcacctgccacctgggcctctctatggctttcatggtcccccagcacagcatttctcttcatggttctgtgatgtgatccatttgtctggagcrgcttctgttggatttgtcagtaagcgttgctcttgcttttattggtggtgtcatcgtgacacccccaaaccaaggtcccaaggtccagacagtgagagct

SEQ ID NO: 72704 - DNA, 201 bp, Homo sapiens
acacaagcaactctgagatgaatgcttttggggtgtgcatagagcagggtcctcagctgggttctagagccagcccaggccgggcctgagctgaatggcayctgccacctgggcctctctatggctttcatggtcccccagcacagcatttctcttcatggttctgtgatgtgatccatttgtctggagcggcttctgttg

SEQ ID NO: 72705 - DNA, 201 bp, Homo sapiens
ggggctgtctccacttggggtttgctttccagagggaagggggttttcgtgggagagtctaggagagggcagcacctgctttagctctggactccttgacyccgcctccagccctctgaagcagggtttcagggcctggctgcttgtcagcatgggcctcaggggatggagagctccgaggagcaaggcgggaggccctga

SEQ ID NO: 72706 - DNA, 201 bp, Homo sapiens
atgtctttttttaatcctcacatttgatggttgggtatagaatttctaggtggaaagtgcttttcccttagaacttctacaacatcactctgatgtcttayggcttctagtgtggctgtggagaagtctcatgtcattctgatttgctgatcttcctaaaagcttcatctcttagagggagctgagagtttctcatgcccc

SEQ ID NO: 72707 - DNA, 201 bp, Homo sapiens
ctggattaaggggattccacctgtgtgttggcccttctagtcagacggaagagcagaacagggctaaactggggtgtctgtgggaaacggctctaccccarccttatatagtcaaacacaggggctgttctttcccttccttcttcttcctggagtcatgccttctggagttctctgtccccagctacaatctgtgcctgt

SEQ ID NO: 72708 - DNA, 201 bp, Homo sapiens
gaacgctctgtgtttttattgtacagaacgtggacatctcaagacctccagaggaagcccttgtcacggtgcctgctcaccagtgaccatgttcatccacygtgaccactaggcaggcactgctctctgcagagggggtcattccaggccctccagtgtgtgtgatagtcaccatgccatgcagggatattcttgaagcca

SEQ ID NO: 72709 - DNA, 201 bp, Homo sapiens
gcccactcggggtgaggcttggccccagctgtctaaggggagctttgtggggcatgacgaagagaatagagaaggcctattctctattatttggcctgggrttgggtcaaggtcagggttggtaggggttgctgttgctgtgaaagctgagcctctccttccctccagagttcaatgttggccagtatcgccgggacgtgg

SEQ ID NO: 72710 - DNA, 201 bp, Homo sapiens
gcctccagccctctgaagcagggtttcagggcctggctgcttgtcagcatgggcctcaggggatggagagctccgaggagcaaggcgggaggccctgaacrtgtccgtgttcctccctcccaccaccccggcgcttctggtcctgccgcagaccttttttgtcgagtccatctgtgtggatcctgaggtcatagctgccaa

SEQ ID NO: 72711 - DNA, 201 bp, Homo sapiens
gttggaagtgcaaggcctcgcagctagattccgtggctagccagatgtgctctgtgagaaccctggccacgctcacaggcctctttctactttctctctgsacagggacctgtcctatatcaagatcatggatgtgggccagagctacgtggtgaaccgtgtggctgaccacatccagagccgcatcgtatattacctcat

SEQ ID NO: 72712 - DNA, 201 bp, Homo sapiens
gaacccaggaggaggaggttgcagtgagccaagatatgtcactacactccagcctgggtgacagagcaagactctgtctcaaaaacaaaagaaaagaaaasaaaacaaaacaaaacaaaagcatatacttgctttgagttttagcctagcccaagagcttttttcatcaaggcatctgcaaccacttaggtttattattat

SEQ ID NO: 72713 - DNA, 201 bp, Homo sapiens
tctttatgactttgactactttatatacctcatataagtgaaatcatatagtatttgtctttttgtaactggttactttagttagcataatatcctcaagsttcatccatgttgtagcttgtgcaagagtttccttcctgtttattttttaagacagcatctcactctgtcacccaggctacagtgcaatgtggaaatcac

SEQ ID NO: 72714 - DNA, 201 bp, Homo sapiens
aacccgtgaactttctaaagctgtactccctgcatatttttagtatgagcttcctgaaaatagagatgatgccatttttatctttccctctctcccctacsagtgtctagctagttcttggcccataaaaaaacactcagtaaatgtctgaatggataagtaaataattggttgtggctcatgagacaaagataatttgaa

SEQ ID NO: 72715 - DNA, 201 bp, Homo sapiens
tcctggagactgtactggttcttgcgaggccaagtcttgacctcgaggtggcgctgctcttctccttgctaggcctcctggcctctggttgcccagggccyaggtgaaatgcagttagagagcagggcttgtgtgctgatctctcccctcccttcacttcctttctgccccggtgaccagtaccctcgccccagagacacc

SEQ ID NO: 72716 - DNA, 201 bp, Homo sapiens
cccctctggcacgggtctggtgtctcctggcaagatactcaggctcccttttgttgtaggagctcctgggaggaagccaaaaatagcagtaaatactgaawagggcatcctgttgcaaacagaaagcagtagggaggtgtgaggccgagagaggcaaaaagcctgcttggccctcatccccactgactcagagaaggatgg

SEQ ID NO: 72717 - DNA, 201 bp, Homo sapiens
atcctaatgtcacctgagaatgcacctggccttagtaaatctttgtggtaatttttgaagggcgcaattccttgctggaattgaaaacactattgtgagtyactcctactgacacccccagatcatttataaagaccttgagaaagcaagatgattctggtaggctcttcattaaactggcagcaggaggtggggcttaga

SEQ ID NO: 72718 - DNA, 201 bp, Homo sapiens
attttttttttttttgcctttgctaaaagaatctgttggtctgaggccgggcatggtggctcatgcctgtaaccccaacactctgggaggctgaggcaggyggatcgcttgaggtcaggagttcgaaaccagcctggccagcatggtgaaaccctgtctctactaaaaaatacaaaaattagctgggtgtggtggcacatg

SEQ ID NO: 72719 - DNA, 201 bp, Homo sapiens
cctttctgaggagatgacacataggtgagacctaaggcaagaggatgagccagccatgtacacttggcgggaaggacattccagacactgcacatgtccasaggcaggaggcagattgacatgtttgaggacagaaagaaagccagaatggctgcagggtagtaagtaaggtggagtttgctaaggtgaaggtccggagcc

SEQ ID NO: 72720 - DNA, 201 bp, Homo sapiens
ccgttgtattcagcgctctcccccggctgcaccttggaattgccgaagaagctttttttaaactccagatgggccgggtgcggcggttcacacctataatyccagcactctttgagaggccgaggcgggaggatcgcttgagcccaggatgacctcctgggcaacatagtgggactccgtctctacaaatcaaaaaacaaa

SEQ ID NO: 72721 - DNA, 201 bp, Homo sapiens
gccttgcccctgggagctgggccggttccaggaggacgaagactgaattagctcggcttgcagagaaaggcgagcagcgcccctacacggagagtagcggkgcgcctacaaagtcgcgcatgcccactccggcctcccgctccactcctaaggcaggcggcgaggcttagtgcgcaagcgccattcgtcggcgccgactcc

SEQ ID NO: 72722 - DNA, 201 bp, Homo sapiens
ccctctctctttttgtcttccccttttgcagacaccttggaagagcttaaggaaatagataaaggcatgtggaagaaactgcaggagaagtttgcccccargggtcctgaggaggatcataaggcctgagctcaggccttacctcgtgcacatacctaggtgtggagtcttgtacattgccatcgtcaataaaactgcccc

SEQ ID NO: 72723 - DNA, 201 bp, Homo sapiens
gagagaatacccaggtgaccggcggggaggcggctgggacgaggggaggaaaggacgaggcaggggcggggccaacgagcgcgctagcagggggatctgckcatgcgcgcgccctctttccaggcagcacgtgagcgcggaccccctttttcccccagggagctactgatagcgacgcccgttgtattcagcgctctcccc

SEQ ID NO: 72724 - DNA, 201 bp, Homo sapiens
gcttaaggaaatagataaaggcatgtggaagaaactgcaggagaagtttgcccccaagggtcctgaggaggatcataaggcctgagctcaggccttacctygtgcacatacctaggtgtggagtcttgtacattgccatcgtcaataaaactgccccagtttccccttgaccttacggtttgggaatctcctctagctttc

SEQ ID NO: 72725 - DNA, 201 bp, Homo sapiens
acctcgtgcacatacctaggtgtggagtcttgtacattgccatcgtcaataaaactgccccagtttccccttgaccttacggtttgggaatctcctctagytttcccagaaaggaagcccttgctgctctaaagaaagtttcagcctgagaagggatggtgattgagctatctgctgtgactgctgctcagggtagggaaa

SEQ ID NO: 72726 - DNA, 201 bp, Homo sapiens
gacagagtgagactccatctaaaaaaaaaaaaaaaaagaagtgagagtacctgagggtcactttgctttttgcacttagactttgtacattttgctcttayaggagcagcactctgcaagggtgacccgccccccatgcccctcctgtctgtcctgctgctcatcagggatgggactacgtggcaaggaaggacagcacct

SEQ ID NO: 72727 - DNA, 201 bp, Homo sapiens
actccacgtccgccttgcccctgggagctgggccggttccaggaggacgaagactgaattagctcggcttgcagagaaaggcgagcagcgcccctacacgsagagtagcggtgcgcctacaaagtcgcgcatgcccactccggcctcccgctccactcctaaggcaggcggcgaggcttagtgcgcaagcgccattcgtcg

SEQ ID NO: 72728 - DNA, 201 bp, Homo sapiens
caattctacaaacccgtgaactttctaaagctgtactccctgcatatttttagtatgagcttcctgaaaatagagatgatgccatttttatctttccctcyctcccctaccagtgtctagctagttcttggcccataaaaaaacactcagtaaatgtctgaatggataagtaaataattggttgtggctcatgagacaaag

SEQ ID NO: 72729 - DNA, 201 bp, Homo sapiens
caggagcacgcccagtggcatcattgtgactgtactgctgattggctggcagcctggggagtgtctggcccaggttatacgatacccagggccctcacatyattcatggtggtcttcactggcccaaagtgtaaagatctttaaggcaagaatcttatctagtcccaattctacaaacccgtgaactttctaaagctgtac

SEQ ID NO: 72730 - DNA, 201 bp, Homo sapiens
ccaatctatgtcatcaagttttagacttcagtccctctctctttttgtcttccccttttgcagacaccttggaagagcttaaggaaatagataaaggcatrtggaagaaactgcaggagaagtttgcccccaagggtcctgaggaggatcataaggcctgagctcaggccttacctcgtgcacatacctaggtgtggagtc

SEQ ID NO: 72731 - DNA, 201 bp, Homo sapiens
gtgtttactacaactctttactactaataactgtgagaaaaactaatcgctcacatttatcggcgttccaggcccggaattcagagcagcccaagcgtcamctcatttatcctcacaccaccggggacgtaggggctattattatattttcttttaaaagaaaggttaagttggccagtatgctttaaaaatgttcagtgc

SEQ ID NO: 72732 - DNA, 201 bp, Homo sapiens
tactgtcaaattccatttagagtggtttttcccatacttgaaaaatatgctcattaactccacaaacatttgtggccatatgcctatgtggaaaattgatkttttctaaatcctccctgctaacatgtgatccatgagcagcagcatgggcatcacctgggaactggttagaaatgcagaatcaggggccccacccatacc

SEQ ID NO: 72733 - DNA, 201 bp, Homo sapiens
gtgactagaataggggccgctgtaccaattgctgtcaccacccaaaattcaatttgcaaaatcgaaatcagtgcctgcagcactgatgtagatttgtatgyataaaagtttaatatggtaaagagaaatttactgacgactgaacaggggaaatgcaaaaggagcaaaaatagagctataaaggacactcgtcagatgaac

SEQ ID NO: 72734 - DNA, 201 bp, Homo sapiens
cagttttgcttgatggaaagtcttgtagaacagcccagaggaaattctgaagctacagggcgcatgcattttgaccatatactgtggagaaggtcaaaggygttatttaaaaaagaaaatctatctttagggcttttaaattcaaggctgggcatcagggaacagaggaatacatatttgccaaatggaagtagttgaaat

SEQ ID NO: 72735 - DNA, 201 bp, Homo sapiens
ggaattgaggccgagtaccaagggatagtgacaggtacgggggcacccacgaacaacgttcaaacatattttcatccagtaacctgtatttacatgcaaayatattggtttatgcaaaacagcggaggcctcgggggagggttttttagtctcaagcttgtgcagtcattgaaaaagagacgcaaagctgtctctggggta

SEQ ID NO: 72736 - DNA, 201 bp, Homo sapiens
tggaactccctgtgtttacccacctattctttgccccagccactaccagtccagatgggaagaaagatggtcctgggtgggacaccaggcggagaaaagckgggttaactaaagggcaaatcaataattcatacacaaaaccagagtacaaaaaccactgcctccatttattccacctcaaattgccctctggggagtctt

SEQ ID NO: 72737 - DNA, 201 bp, Homo sapiens
cggggcctcagctgcagttggcttcagcactgtgggcaggttctgtaggtggccacaagtcagaggccctgctggctgaggacacacacagggtcacctcrttattccatggaaccttggctcttactgatattgagcatccttctctctggaaccgtgagggacagggctgggcccacagcggccctggtgggtacaaag

SEQ ID NO: 72738 - DNA, 201 bp, Homo sapiens
gatctcatttaatccttagtacagctgagtggtagccattactgttcccattttacagatgaggaaacatcagaaaaacaagacaacgcactgggggttcygtagccataagagacaagccaagtgagaaacagacccagcccctctggccctagtgtgcatcgtctcctgggtgcctggcctttcctcagctgctgttcc

SEQ ID NO: 72739 - DNA, 201 bp, Homo sapiens
atcttaaatgttgccttcttcatgtttctttccttcttgtagagtttcagcagctccccacttatcatagattgagaactcagatgattttttttttttttgcctttgctaaaagaatctgttggtctgaggccgggcatggtggctcatgcctgtaaccccaacactctgggaggctgaggcaggtggatcgcttgaggt

SEQ ID NO: 72740 - DNA, 201 bp, Homo sapiens
gtgtctcctggcaagatactcaggctcccttttgttgtaggagctcctgggaggaagccaaaaatagcagtaaatactgaaaagggcatcctgttgcaaasagaaagcagtagggaggtgtgaggccgagagaggcaaaaagcctgcttggccctcatccccactgactcagagaaggatggaccttaggcctctatccct

SEQ ID NO: 72741 - DNA, 201 bp, Homo sapiens
cttatctagtcccaattctacaaacccgtgaactttctaaagctgtactccctgcatatttttagtatgagcttcctgaaaatagagatgatgccatttttatctttccctctctcccctaccagtgtctagctagttcttggcccataaaaaaacactcagtaaatgtctgaatggataagtaaataattggttgtggct

SEQ ID NO: 72742 - DNA, 201 bp, Homo sapiens
ctgaaaggtgcacagtgcacctttgccggcgtgatctcatttaatccttagtacagctgagtggtagccattactgttcccattttacagatgaggaaacatcagaaaaacaagacaacgcactgggggttccgtagccataagagacaagccaagtgagaaacagacccagcccctctggccctagtgtgcatcgtctcc

SEQ ID NO: 72743 - DNA, 201 bp, Homo sapiens
gtgagggcggaagtaagttccagaggccctgcctctgccctctgttttgttcacctcagggcagcctctgcaagtggaaaacaggcagcaacgaaggctgsgagatagtcccgccattggtccgcgctgcagcttgttctggcagcgagtttagttcaggaaatttgctgagaatttgttttcacagcaagcctcatattt

SEQ ID NO: 72744 - DNA, 201 bp, Homo sapiens
attcacatagtttggattatcatttattgcaggtgaccaaaaatcctttcacactgggcgacagttccaatcctggacagacggagagactacaggagttwagccagaagatggaccaggtaagaggtcactggccagtcagtacttagaatcctggggctccagtgaacaggaggctgcatgctcatgtcttgccacttt

SEQ ID NO: 72745 - DNA, 201 bp, Homo sapiens
actgagacagctgcccttgtccgcagtctatcactgctggtattaattgggcaggaggcctctggttggctttctttgcttctgacttaaagcttaaactracctctcatttcacagtctgagacttgcagtgtggaaatcccagagctagaatttgaactgggaatggcagtcctcgggggcaagttcaccacactggaa

SEQ ID NO: 72746 - DNA, 201 bp, Homo sapiens
acaggaaaggagtctcctgaggggagaccgagtccagcacaagtgaaggagttaccattgaaatgatgactttcaaacagcactggcctctgtattgaccytatccttgtttgatatcatgctgttagaattcagcctcctaaagaaaattttcccgtgtatctactgtaatttggggattgcagctggcatttaattcat

SEQ ID NO: 72747 - DNA, 201 bp, Homo sapiens
tggtccaggcggtcggatcttaaataaatccccctatgtctcctagccttagtttcttttgtaaaatggtactggtgttgtcatcagctcaagtgagatamgatttgtgaaaatgctttgtaaatgttgtctgagggtatgaaatgagcagtagttgttatgaatagtattctcaccatttggacagcctggctcacacca

SEQ ID NO: 72748 - DNA, 201 bp, Homo sapiens
gtgtctttagcctgaacatcccatctgggagggctcaccctttgtcctcatgttgtgttccaggtgctccagttcagcacaaactgcccagaatgcaatgyccccgctcagaccaacatgaagctagtacgtatcttttgccaagcagttgggttgctcttcatctgactcaggcatgaagattataatcaggctgggagc

SEQ ID NO: 72749 - DNA, 201 bp, Homo sapiens
ccttattttgttagagcatcttctccagtagcttcctgggaaaaagtgcatgggaaataaaatttctgggaccttccacatctgaacatgtctttattctrttatcacactagagtgattattggctgggaatacgattctaggatagaaataattttttatcagaatttcgaagactgcactatggtcttccagtttggt

SEQ ID NO: 72750 - DNA, 201 bp, Homo sapiens
ggtagaaagtaatggtaataccatagtgtgtttattgtagaattttagcatcactattatcagacatgaatggaaccttgcacctggccttctcattttayagatgaggaaattaagacccagagagttcaagtgaattgcccagggtcatacagggacttgatagcagagctgaggctaagtcacacttgtcttttgttc

SEQ ID NO: 72751 - DNA, 201 bp, Homo sapiens
ctttcagtgttaagggctttgctcagatgtctgataatcattgattgtcttcttacaagtagcgggctaaagacctgagtagggggtgagccttgttgacmtggggcttattacaggggaatttaacttagctgttttgctgaggtggcctccaatgccagaattgttaggtctttcctcttgggctagtcagacaaagag

SEQ ID NO: 72752 - DNA, 201 bp, Homo sapiens
cgctgctctttctgtaggttatttattagtattggatgaaggcgaaggctgggagtgtctttcccaccagcccttgcccatggtggggaggacatctggtytgagtcagagatctgtgcacactttctaaacagcttgtgatgcaagtgtgagcctattgtgttacttgaccttattttggaagttttgaattggcctagg

SEQ ID NO: 72753 - DNA, 201 bp, Homo sapiens
caagcacaccacagaacagaggacaaaataaatctctttcatggaacttgaagtctagtggggaaaaatgacaataaacagatgaggaaaacagtacatcrgatggtgattagtgtcatggaggaatgtaaagcagggaatggggctgggttgtgcaaggaaatggggagtagggaagatcttctgaacaagaaggtgata

SEQ ID NO: 72754 - DNA, 201 bp, Homo sapiens
gtcatttattttactgtaaagttaggggatgagggtccttctagcacctaaaacttcccaacataaaaaacatacatgtatgggttgacttagcccaaatrtttatctccttgatgaattatttcacttgattctctgttgggcattttgtatttgtaaattgtactttttctttgcatttcttctccaaattagtatcag

SEQ ID NO: 72755 - DNA, 201 bp, Homo sapiens
ttggcaatttgggataagttttggcacgttaccagggttgggcactgttcctggccagctcttggtgtttttggtttgggcgactgctgtttagaaggctmtttctttggtagctattaatggccctaactgattggatgtccaagcctacactccaggtctcctgggtaccaagtgaggctcaggtcttctctctgttgc

SEQ ID NO: 72756 - DNA, 201 bp, Homo sapiens
gcttatctactttatgccaagcacaccacagaacagaggacaaaataaatctctttcatggaacttgaagtctagtggggaaaaatgacaataaacagatsaggaaaacagtacatcagatggtgattagtgtcatggaggaatgtaaagcagggaatggggctgggttgtgcaaggaaatggggagtagggaagatcttc

SEQ ID NO: 72757 - DNA, 201 bp, Homo sapiens
aaggagacccacacattggatgcagtggatgaaaggactgcaataaatgcttaaaagtctctttcaaccccaaaagtcttttttttttttttttttaaggkaaattcagagtttattggcaatttgggataagttttggcacgttaccagggttgggcactgttcctggccagctcttggtgtttttggtttgggcgactg

SEQ ID NO: 72758 - DNA, 201 bp, Homo sapiens
cagagaagtggtgaagactgactctgctgccacaaggattcctgagctagattttgaaattcctgcctttagccagaaaggaggtaagtttaagatcagartatttgggctgttcgcatgtagctagaatcttaccctctttcttgcaaaaccccctggtgccaggtctagtggtttgtgtatgggttctaccatgtaatc

SEQ ID NO: 72759 - DNA, 201 bp, Homo sapiens
tcattagttaatcatgagtggaaagcttaggtaaaacagctcgagatggtagaaagtaatggtaataccatagtgtgtttattgtagaattttagcatcaytattatcagacatgaatggaaccttgcacctggccttctcattttacagatgaggaaattaagacccagagagttcaagtgaattgcccagggtcataca

SEQ ID NO: 72760 - DNA, 201 bp, Homo sapiens
gagacctcctcaaggtaacagtctgcttgggaaagtcactgttgtcctcataagttagataaactgtctctatctaggggaagttgtcttttagaaataaygttcagggacatgaggtatctcctacttccctggctttgaggacccctgagcagagggagttaatctaagattggaattgcaggtttagaaggtgaccct

SEQ ID NO: 72761 - DNA, 201 bp, Homo sapiens
gagagggagagacagctgggctgcggtctgatggaaggggacggtctggttattacttgaggagaagctgttctgcagtctctttgtactgaacgtattcytttcttcccaggacatgaacagagaagtggtgaagactgactctgctgccacaaggattcctgagctagattttgaaattcctgcctttagccagaaagg

SEQ ID NO: 72762 - DNA, 201 bp, Homo sapiens
ggcacgttaccagggttgggcactgttcctggccagctcttggtgtttttggtttgggcgactgctgtttagaaggctctttctttggtagctattaatgrccctaactgattggatgtccaagcctacactccaggtctcctgggtaccaagtgaggctcaggtcttctctctgttgctcctgactgttatcgatgcagg

SEQ ID NO: 72763 - DNA, 201 bp, Homo sapiens
gggctgttcgcatgtagctagaatcttaccctctttcttgcaaaaccccctggtgccaggtctagtggtttgtgtatgggttctaccatgtaatcattgtratcttcattagttaatcatgagtggaaagcttaggtaaaacagctcgagatggtagaaagtaatggtaataccatagtgtgtttattgtagaattttagc

SEQ ID NO: 72764 - DNA, 201 bp, Homo sapiens
cactttgtctgtcagggctctggaggtgagaggacctcagagcaggtacctcagtattctagagagagattcggtactggggtcagagctctggtccaggmggtcggatcttaaataaatccccctatgtctcctagccttagtttcttttgtaaaatggtactggtgttgtcatcagctcaagtgagataagatttgtga

SEQ ID NO: 72765 - DNA, 201 bp, Homo sapiens
caggaagaagctgaaattttggatatacaaacacagaccccattgaatgatcaggcaacaaaggctaagtcaacccaggatctaagtgaaggcatctcacrgaaagatggtgatgaggtctgtgaatcaaatgtgagcaatagcataacttctggagagaaagtgatttcagtagaacttggattagataatgggcattct

SEQ ID NO: 72766 - DNA, 201 bp, Homo sapiens
aatgatcaggcaacaaaggctaagtcaacccaggatctaagtgaaggcatctcacggaaagatggtgatgaggtctgtgaatcaaatgtgagcaatagcayaacttctggagagaaagtgatttcagtagaacttggattagataatgggcattctgctattcaaacgggaactctaatccttgaagaaattgaaacgatc

SEQ ID NO: 72767 - DNA, 201 bp, Homo sapiens
ttacaagccatagagaaactgggcatttctatactagagaaaccacctaaaacaactgtatggagtaagatgaaaggtatgaatatgcctggaagaaattktacctagtgtgacatttttgctcatctttttgtcacaaaaggctgctaaggaagagagaatacagttttctagagaataagagtgcagtgtaaaaatgga

SEQ ID NO: 72768 - DNA, 201 bp, Homo sapiens
cagtaacagtaccctagaaagtgcaccaaatggaaaagactatgaaagtacagagattgtagctgaagaaactaagccaaaagatactgaattgagccaaraatcagattttaaagaaaatgggatcactgaagagaaatccaaatcagaagaaagcaaaagaatggagccaattgctattattattacagacactgaaat

SEQ ID NO: 72769 - DNA, 201 bp, Homo sapiens
ctgaagctgctgatgtggcaaggaagtgtccacaagaagcaggagcttctgatcagccagagcccacacggggggcctgggcctcactcaaacgtcttgtmacacgcaggaaaaggtcagagtcttcaaagcagcaaaagccattggagggtgaaatgcaacctgcaataaatgctgaggatgctgatctttctaagaaaa

SEQ ID NO: 72770 - DNA, 201 bp, Homo sapiens
ggagcttctgatcagccagagcccacacggggggcctgggcctcactcaaacgtcttgtaacacgcaggaaaaggtcagagtcttcaaagcagcaaaagcyattggagggtgaaatgcaacctgcaataaatgctgaggatgctgatctttctaagaaaaaggcaaaatctagacttaagattccctgcataaaattccca

SEQ ID NO: 72771 - DNA, 201 bp, Homo sapiens
caggcaacaaaggctaagtcaacccaggatctaagtgaaggcatctcacggaaagatggtgatgaggtctgtgaatcaaatgtgagcaatagcataacttytggagagaaagtgatttcagtagaacttggattagataatgggcattctgctattcaaacgggaactctaatccttgaagaaattgaaacgatcaaggaa

SEQ ID NO: 72772 - DNA, 201 bp, Homo sapiens
gaaagatggtgatgaggtctgtgaatcaaatgtgagcaatagcataacttctggagagaaagtgatttcagtagaacttggattagataatgggcattctsctattcaaacgggaactctaatccttgaagaaattgaaacgatcaaggaaaaacaagatgttcaaccccagcaagcaagcccacttgaaacttcagaaac

SEQ ID NO: 72773 - DNA, 201 bp, Homo sapiens
tatctactccaaaagaacgtgtgtcaagacgctttgggcggagttttacctgtgatagctgtggatttggctttagctgtgaaaaattattagatgagcaygtgctaacctgtactaacagacatttataccaaaacacaagatcttaccatagaatagtagatattagagatggaaaagacagtaacatcaaagctgaat

SEQ ID NO: 72774 - DNA, 201 bp, Homo sapiens
cggaggttgcagtgagccgaaattgccccattgcactccagcctggatgacagagccagaccctgtctcaaaaaaaagaaaagaaaaaagaagtcccaaasagagtgagctagacattgaaaaggttctaagcaaaggaacagcatgtgtgaaatggcaaggcttttggtgtgttaggttatttgggatcgggggaatctt

SEQ ID NO: 72775 - DNA, 201 bp, Homo sapiens
tttggcagcattaataaagaggtcaaaaaaatgaaaaaagagcaaactcctcttggaatttgagtgaaattataatttaatgaaagtgaatgcctcataattttttttttttttttttgagatggagtcttgctctgtcgcccaggctggagtgcagtggcacagtcttggctcactgtaagctccgcctcccgagttccc

SEQ ID NO: 72776 - DNA, 201 bp, Homo sapiens
aacactttatacagtgcctggtataccaaaggtagtcagtaaatgtttgttgaatgaataaatgtgcattaaaatgctataagtgctcttatttaaatgtyttagtgttttatgttaataaaagaatatgtatttttactcagttgaattgtgactatagctatagatgtgcctatcatattgatcttctatgtagttgta

SEQ ID NO: 72777 - DNA, 201 bp, Homo sapiens
tttgtgtatttttttcatcttttttccccccaccttttgaataaggttgtggcgtggatttgttttatataattctaacataattatgtatcctgtgtttrtttatttggctctccatcttgaacatttttcccacttctgtagttgccatttagaaatatatatatatatatatatatatattttttttttttttttttt

SEQ ID NO: 72778 - DNA, 201 bp, Homo sapiens
ttaggtattaaatgtttatcatttttgttgtttcttaatagaattatttgtttttagtttttcttagctatgattaaaatttttaaatgtagactacaagyggttgttacccattcaatgactattaaactttagtttttcatcaataaggtgatgacttcactatttctatgtgtttttttttttttaaggttatcctgt

SEQ ID NO: 72779 - DNA, 201 bp, Homo sapiens
atttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactca

SEQ ID NO: 72780 - DNA, 201 bp, Homo sapiens
tttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcac

SEQ ID NO: 72781 - DNA, 201 bp, Homo sapiens
agaaatgacgcacatgggttaaatggtatatggcaaactaacagtttgagtatggacaaaaattcaattagaagaaaggatcccagaggggctaataattwaaaaaaaaaaaaagtttgctagagcagtcaggacactaattaaaaggaaaagtagaggctgggcaccagcaccttgggaggccaaggtgggtggatcacc

SEQ ID NO: 72782 - DNA, 201 bp, Homo sapiens
attaccttatttctatactactatgttaaacctactactttaatgatctggctaccgtctgccaaatgtcacttttcaagtgagaacagaagaatgagatwgtgaagattctgtggacaatgtctatataatcatttaagtgttaaatataaactaaatgacaatagcagcttgtaaattaatgctaattctggctgggag

SEQ ID NO: 72783 - DNA, 201 bp, Homo sapiens
ttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcact

SEQ ID NO: 72784 - DNA, 201 bp, Homo sapiens
ctggagtttgaacctaggtttctgacttctacattcctgtactccacctatcaagaagtacaaagaagggccttttcagcctagaaacacatgtgataaarctcctatgagattgtgctccttgttcatctgtcatctgctgtgctggtaaggtggctagtaatagtgggtacccaattaacatgctgaataatgtgaaaa

SEQ ID NO: 72785 - DNA, 201 bp, Homo sapiens
gctgtggtcagagaattgcttgagcctgagaggtcaaggctgcagtgagccgtggttgtgtcactgcactccagcctgggcaacagagcgagaccctgtckcaaaaaataaaaacaaataaattcatcatatctttgactaataaacagaagaacccccttccccagttaccataggtgattgatttgattaagatttata

SEQ ID NO: 72786 - DNA, 201 bp, Homo sapiens
tgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcactg

SEQ ID NO: 72787 - DNA, 201 bp, Homo sapiens
ataattttactcagaatcactagggcagattaggaggcttataagcctaggaatttgcaggaaaacccctcctcttcttttgtgcgtgtatgtgtgtgtgygtgtatgcttcattttcatttgcagagtggctgaagacagtaaaaagaatatgaactttaaaaaaattgttagatttatgtttcaatcagagatttgtca

SEQ ID NO: 72788 - DNA, 201 bp, Homo sapiens
aattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcactgcaacctccctcagccaggctg

SEQ ID NO: 72789 - DNA, 201 bp, Homo sapiens
ttatgtatcctgtgtttatttatttggctctccatcttgaacatttttcccacttctgtagttgccatttagaaatatatatatatatatatatatatatwtttttttttttttttttttgagacagtcttgctctgtcagccaggctggagtacagtggcatgatctcgactcactgcaacctccctcagccaggctgga

SEQ ID NO: 72790 - DNA, 201 bp, Homo sapiens
gatagattaataagaacatcttatatttgaatggtacgagttacattcgggaaataattaaatttaaattctaggggctatgcttgtgtttctattctctrttctgttaacagtgtgttggcctagtgccaaagccaagaaattctgatctaagaattatgttgtatcttgtagagcagtcaacttgtaatattatttttc

SEQ ID NO: 72791 - DNA, 201 bp, Homo sapiens
acccactgaagggttcaaatacatgtgaattctactgctttaagagaaataaaacaaataagcctagggaaatattagagtctaaaaaaccctagagttamtctcttttgggaacataaggaggtatacagaactgcagacctctaaacataagtaggaaaaagaaaaataaaagaatattaccaataattaaaggtgcca

SEQ ID NO: 72792 - DNA, 201 bp, Homo sapiens
agaggcatctgcctcaccctaagatcagaaaaaacttcccaaagaggccaggcacaatgtctctcacctgtaatcccagcaccttgggaggcctaggcagrcggattgtttgatctcaggagtttgagaccagcctggccaacatggcgaaaccctgtctctacaaacaatacaaaagttagctgggcgtggtgccgcatg

SEQ ID NO: 72793 - DNA, 201 bp, Homo sapiens
gcaagagcaggaaaggtagggatggagtagatgggcagatttgagaaatatttaatgggaaaattggcaacacttaatggttgattatgagggagaagttmtaggtagctcccaagtagtctaggtgattggtacatagtggtggcagctgagacaaaatacagggaggggcatttttaagtgggttccagacaaaatctg

SEQ ID NO: 72794 - DNA, 201 bp, Homo sapiens
gctctggttcctgttgcggccggtaagtatttgccagttgtggggctatttgcgcaactttggcccaggccggagggcgacgggccgcgggcctggcggastgcggggccggaggggcgccgatccgtgcggggagccggagcgcggcggacgcgctgcgaggacccggtgacgggcggctgccaggccgcctgcttgttg

SEQ ID NO: 72795 - DNA, 201 bp, Homo sapiens
ctgggattacaggcgtgagccacggtgcccggcctcaaaaatttttaatgaaaaaattatcttcaagagataagctaaaagtctcacaggaatttagatcyctcctcccctgccgcatactcctctacctgtttttggtgtagtaatccttcttaaagcttttctgggctaggcacagtggtttatacctgtaatctcagc

SEQ ID NO: 72796 - DNA, 201 bp, Homo sapiens
ctttcattactcatatccttcaagagttgttttctttttttttttttcttttgagacagagtcttgctctgtcatccagactggagtgcagtggcgtgacrcaactcactacagcctctacctgtcgggctcaagtgatccacccactttagcctcccaagtaactgggactacaggtgatgccaccacacctggttaatt

SEQ ID NO: 72797 - DNA, 201 bp, Homo sapiens
gactttaatatttttgttttacataggtctctaattaacagaagatggcaaagcccagccacagcagctatgtccttcagcagctaaacaaccaaagagartggggttttctctgtgactgctgtattgcaattgatgacatttactttcaagcacacaaggcagttctagctgcctgtagctcctattttagaatgtttt

SEQ ID NO: 72798 - DNA, 201 bp, Homo sapiens
atgactttgggagctagaaagggggttcctcctcttaaagaaacaggaaactgggccgggcgcagtggctcacgcctgtaatcccaacactttgggaggcygaggcgggtggatcacccgaggtcaggagttcgagaccagcctggccaacatggcgaaaccccatctctactaaaagtacaaaaattagcctggcgtggt

SEQ ID NO: 72799 - DNA, 201 bp, Homo sapiens
ccagagataatcaccatgtacagttaattccttgtttaaaacgagagaaggcaacatttgatcacagctgtgtgtgcctcactctgcctggggatggcctrtggtgattcatggactcatgttctctgttcacattactcaggttggtaagaattgccaggtagaggaaaggggagtgttttgcattgggctgatttaaaa

SEQ ID NO: 72800 - DNA, 201 bp, Homo sapiens
acattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccg

SEQ ID NO: 72801 - DNA, 201 bp, Homo sapiens
actaaatgtcagacattcagtaatgactgagatactgccctgatgtcaaggagcttgcagtaaagcaggggagccaaataattgcaatatctgccttaagygtggtaacagagcatcacagttgggatgatgcattattggtaccatattgttgtatgtataggctgttttggcagcacagaagaggcatctgcctcaccc

SEQ ID NO: 72802 - DNA, 201 bp, Homo sapiens
cattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgc

SEQ ID NO: 72803 - DNA, 201 bp, Homo sapiens
gatctaggaaaagtaaaaattcctcaaatgaatacagaatacttgtgctactgctgatgatcaacactttatacagtgcctggtataccaaaggtagtcartaaatgtttgttgaatgaataaatgtgcattaaaatgctataagtgctcttatttaaatgttttagtgttttatgttaataaaagaatatgtatttttac

SEQ ID NO: 72804 - DNA, 201 bp, Homo sapiens
ggtagaaaggattaccatcccttcttagagaattgaagcacaaattgactaagcaaccttctcaaggtcacacacttaataagtggcagagccagaatttraacccaggcagtctggttagtttgtgctttaacacctactttatgtagctgttctgattattaaaatacagtgtaaaaagtgcaaaataaagaggtaata

SEQ ID NO: 72805 - DNA, 201 bp, Homo sapiens
attctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgcc

SEQ ID NO: 72806 - DNA, 201 bp, Homo sapiens
tgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctgaacactaatagcattgctcttt

SEQ ID NO: 72807 - DNA, 201 bp, Homo sapiens
aaattttctaaacttgatcgtgtttgtcacttaagtgcgttgaaataaaacctcttatctttgggagcctctacaactggttattcctggaagtttcaagragaaacctagagaatgtaatagagattggaccctataccctgcaagatggtattctaggaaagaattttgccaatgtgacattatttttatagatggcag

SEQ ID NO: 72808 - DNA, 201 bp, Homo sapiens
attcaagaaaagacaaaggcactgatcaaacttgtttggtgccatttctatataatctaataaggttgttgttgttgttgttgttgttgttgttttgaaayggagtctcgctctgtcgcccaggctggagtgcagtggtgcgatctcggctcactgcaagctccgcctcccaggttcatgccagtctcccgcctcagcctc

SEQ ID NO: 72809 - DNA, 201 bp, Homo sapiens
gttgcccaggctggagtgcagtggctcaatctcagttcactgcaacctctgcctccaggttcaagcgattctcctgcctcagccccccaagtagctgggaytacaggcatccactatcatgcccggctgatttttgtatttttgtagagacagagtttcaccatgttggtcaggctggtcttgaactcctgacctcaggtg

SEQ ID NO: 72810 - DNA, 201 bp, Homo sapiens
tggtttcgatctcctgacctcgtgatccgcccgcctcggcctcccaaagtgctgggattacaggtgtgagccaccacacccagccctaataaggttttttwaaatttttatttttgggatagagtctcactctgtcacacaagctagagtacagtggcgtgatcatggctcaccacaacctcaaaatcctgggctcaagcc

SEQ ID NO: 72811 - DNA, 201 bp, Homo sapiens
aaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactat

SEQ ID NO: 72812 - DNA, 201 bp, Homo sapiens
tcataattttttttttttttttttgagatggagtcttgctctgtcgcccaggctggagtgcagtggcacagtcttggctcactgtaagctccgcctcccgrgttcccgccattctcccgcctcagcctcccaagtagctgggaatacaggtgcctgccaccacgcccggctaattttttgtatttttagtagagacagggt

SEQ ID NO: 72813 - DNA, 201 bp, Homo sapiens
ctattcagaaggtgtgaggtggaaggattgcttggagaatgagtacccatattaaagcaggaacagaatgctattgaggacattctgagctatgatggcaygccagcctgggtaacagagtaagaccctgtctcaaaaaaataataattaaaatttaagaaaaaagcttttctgaatgaggtgtaacaaggacagagtttc

SEQ ID NO: 72814 - DNA, 201 bp, Homo sapiens
ctttatgtcttagaggtggcaggatgggcatataggtagtaaaaggggcgtatgacccatatgtgatcgctgaggaatggataaaaagcaaatagaagtaygtaaacgtagatacccttaattactactacagagcttgaagagtgaacattttatttctctaaacagcttgttacatgttctttttaagttcagtcaaat

SEQ ID NO: 72815 - DNA, 201 bp, Homo sapiens
gcatatatccatatatatccatatgtgtatatgtgtaatgtatctgtgagagatatatatacatctccctatacatctgcctggaatagagcctggcatayagtgagacataacaaatgttagctattcatattattattgtattacagttgtcatttactctactttgataaccttcatctaccagtccagtaaagcaaa

SEQ ID NO: 72816 - DNA, 201 bp, Homo sapiens
tctatactactatgttaaacctactactttaatgatctggctaccgtctgccaaatgtcacttttcaagtgagaacagaagaatgagattgtgaagattcygtggacaatgtctatataatcatttaagtgttaaatataaactaaatgacaatagcagcttgtaaattaatgctaattctggctgggagcagtggctcag

SEQ ID NO: 72817 - DNA, 201 bp, Homo sapiens
  misc_feature (1)...(201): n = A,T,C or G, or insertion/deletion polymorphism (see Tables 1-2)
ttataaaatccatgctctttgaaaaattcagcctgtattgaagtacataaaatacaaaaatgaaagtcattttgactcccactccccagagataatcaccntgtacagttaattccttgtttaaaacgagagaaggcaacatttgatcacagctgtgtgtgcctcactctgcctggggatggcctgtggtgattcatggac

SEQ ID NO: 72818 - DNA, 201 bp, Homo sapiens
aagccaacaggtggtgtgcagagccaagttcaacggtaaatacaccacataatagagaggctgatgaagagtctttacaattaggtaattttcctgagccrctatttgatgtatgtaaaaaaagttccgtgtccaaattatctactccaaaagaacgtgtgtcaagacgctttgggcggagttttacctgtgatagctgtg

SEQ ID NO: 72819 - DNA, 201 bp, Homo sapiens
actttaatatttttgtttaggattttaagtatctacatttaggtattaaatgtttatcatttttgttgtttcttaatagaattatttgtttttagtttttyttagctatgattaaaatttttaaatgtagactacaagtggttgttacccattcaatgactattaaactttagtttttcatcaataaggtgatgacttcac

SEQ ID NO: 72820 - DNA, 201 bp, Homo sapiens; identical to SEQ ID NO: 20389

SEQ ID NO: 72821 - DNA, 201 bp, Homo sapiens
ccaaaattttgacatttgagtgctttcgtaagccctgtacatgtactattaattcagtcattcagccaagcctcctcctctagcagcaatttccagctgtktaacactatcctgggcaaatgttttaccctgtcctccagcctccctgcttcccttctggccctggaagactgagtctggacggcagagtggagggactgg

SEQ ID NO: 72822 - DNA, 201 bp, Homo sapiens
tcctgctgcagtgaggggaacagatgggacaataaagactggagactcagttgaataatacaaaactgtttaatactaccaaaaatataattgtatgttgygcggctctccctggctatcatgggaggactgcaggctgcctctgaactgtagtccaacaggagaaagggttgacagcctggggtaggggatgctgctgga

SEQ ID NO: 72823 - DNA, 201 bp, Homo sapiens
tgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctc

SEQ ID NO: 72824 - DNA, 201 bp, Homo sapiens
ctgagacttattttacgccactagagtgagggtgggtagcgtcagaaagagcggggcacggggcgggccagcttcgccgcgggaaaagaacgggaggcggrgtgtccgcagcgcgcacgcgcaacgaaagtcaatggcggtctggagagactggcggaagctagctttgcaatatggcggccgaggcggacggaccgctta

SEQ ID NO: 72825 - DNA, 201 bp, Homo sapiens
tagagacgctgagagaacgggagctagtagcgcccccacccaacgccacctcggagactccggctccttctctctcaacttcgaacaatacaaagtgtgcyaggagaagacaagatggcgcccagcaggaggagcggagaaaggcaggggtgtaaatctggcttccaaactggaagcgtcaacaaaggcgtgggaggtcta

SEQ ID NO: 72826 - DNA, 201 bp, Homo sapiens; identical to SEQ ID NO: 20384

SEQ ID NO: 72827 - DNA, 201 bp, Homo sapiens; identical to SEQ ID NO: 20385

SEQ ID NO: 72828 - DNA, 201 bp, Homo sapiens; identical to SEQ ID NO: 20388

SEQ ID NO: 72829 - DNA, 201 bp, Homo sapiens; identical to SEQ ID NO: 58334

SEQ ID NO: 72830 - DNA, 201 bp, Homo sapiens; identical to SEQ ID NO: 58354

SEQ ID NO: 72831 - DNA, 201 bp, Homo sapiens
agaggcctccagcttggtctgtctccccacctctaccagcatctgctgagctatgagccaaaccagggatttacagggtagggagggtgggataggcagcrgcattagatcggaggaatgagatggacagacctgggctgtgggctaggagggcagtcagctggcctagggtagcccgggctggtgtcagggtaaggagag

SEQ ID NO: 72832 - DNA, 201 bp, Homo sapiens
cctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattggtgag

SEQ ID NO: 72833 - DNA, 201 bp, Homo sapiens; identical to SEQ ID NO: 58328

SEQ ID NO: 72834 - DNA, 201 bp, Homo sapiens
ccccacttcctctgcctgcccctcctcctccttccacgttgtctcctccacctagcagttggttggcaaccccttcctcagtcccctgctgaaaaccctcsagtcagcgcttatcccttctgctctctcccctcacccagagaaatacatggagtttgaccttaatggaaatggcgatattggtgagaaacgggtgatttg

SEQ ID NO: 72835 - DNA, 201 bp, Homo sapiens; identical to SEQ ID NO: 58343

SEQ ID NO: 72836 - DNA, 201 bp, Homo sapiens
caccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactcta

SEQ ID NO: 72837 - DNA, 201 bp, Homo sapiens
attgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattac

SEQ ID NO: 72838 - DNA, 201 bp, Homo sapiens
ctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgtt

SEQ ID NO: 72839 - DNA, 201 bp, Homo sapiens
atataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgat

SEQ ID NO: 72840 - DNA, 201 bp, Homo sapiens
tcaagtccctgacttcctgcctggactccaaagccttcttattgactcctaggaatcaaggtaaggggttaaaatctcataaaacaggattaggactcacmaagtcttctggtgttacagggtgaaagaggctcgtgtgatgtcaccagagggatgtggctaagagctgtgatgtcacctgagggaggcaggatgggttct

SEQ ID NO: 72841 - DNA, 201 bp, Homo sapiens
acccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcgg

SEQ ID NO: 72842 - DNA, 201 bp, Homo sapiens
ttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacat

SEQ ID NO: 72843 - DNA, 201 bp, Homo sapiens
tcaccacatcctcccgaaaagtgtgtggaggaattcaagtccctgacttcctgcctggactccaaagccttcttattgactcctaggaatcaaggtaaggkgttaaaatctcataaaacaggattaggactcaccaagtcttctggtgttacagggtgaaagaggctcgtgtgatgtcaccagagggatgtggctaagagc

SEQ ID NO: 72844 - DNA, 201 bp, Homo sapiens
gtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgag

SEQ ID NO: 72845 - DNA, 201 bp, Homo sapiens
tgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccaca

SEQ ID NO: 72846 - DNA, 201 bp, Homo sapiens
tactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcagga

SEQ ID NO: 72847 - DNA, 201 bp, Homo sapiens; identical to SEQ ID NO: 60418

SEQ ID NO: 72848 - DNA, 201 bp, Homo sapiens
ggagagagatgggggagataaggagagaagaagatagggtgtctggcacacagaagacactcagggaaagagctgttgaatgcctggaaggtgaatacacrgatgaatggagagagaaaaccagacacctcagggctaagagcgcaggccagacaggcagccagctgttcctcctttaagggtgactccctcgatgttaac

SEQ ID NO: 72849 - DNA, 201 bp, Homo sapiens
gggtgtctggcacacagaagacactcagggaaagagctgttgaatgcctggaaggtgaatacacagatgaatggagagagaaaaccagacacctcagggcyaagagcgcaggccagacaggcagccagctgttcctcctttaagggtgactccctcgatgttaaccattctccttctccccaacagttccccagggacctc

SEQ ID NO: 72850 - DNA, 201 bp, Homo sapiens; identical to SEQ ID NO: 60426

SEQ ID NO: 72851 - DNA, 201 bp, Homo sapiens
gagatggggaagagagagagagaaagatggagagacaggatgtctggcacatggaaggtgctcactaagtgtgtatggagtgaatgaatgaatgaatgaaygaacaagcagatatataaataagatatggagacagatgtggggtgtgagaagagagatgggggaagaaacaagtgatatgaataaagatggtgagacaga

SEQ ID NO: 72852 - DNA, 201 bp, Homo sapiens
gctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagat

SEQ ID NO: 72853 - DNA, 201 bp, Homo sapiens; identical to SEQ ID NO: 60421

SEQ ID NO: 72854 - DNA, 201 bp, Homo sapiens
tccactctcccacccaaggggaaatggagacgcaagagagggagagagatgggatgggtgaaagatgtgcgctgatagggagggatggagagaaaaaaacrtggagaaagacggggatgcagaaagagatgtggcaagagatggggaagagagagagagaaagatggagagacaggatgtctggcacatggaaggtgctca

SEQ ID NO: 72855 - DNA, 201 bp, Homo sapiens
agggttagtaccggtatggaagcagtgggggaaatttaaagttttggtcttgggggaggatggatggaggtgaaagtaggggggtattttctaggaagttyaagggtctcagctttttcttttctctctcctcttcaggatcatcttctcgaaccccgagtgacaagcctgtagcccatgttgtaggtaagagctctgagg

SEQ ID NO: 72856 - DNA, 201 bp, Homo sapiens
gggacctctctctaatcagccctctggcccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagtttaagggtctcagc

SEQ ID NO: 72857 - DNA, 201 bp, Homo sapiens
tcttctgcctgctgcactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaaacgtggagaaagacggggatgcagaaagagatgt

SEQ ID NO: 72858 - DNA, 201 bp, Homo sapiens; identical to SEQ ID NO: 60433

SEQ ID NO: 72859 - DNA, 201 bp, Homo sapiens; identical to SEQ ID NO: 60435

SEQ ID NO: 72860 - DNA, 201 bp, Homo sapiens
acctcagggctaagagcgcaggccagacaggcagccagctgttcctcctttaagggtgactccctcgatgttaaccattctccttctccccaacagttccycagggacctctctctaatcagccctctggcccaggcagtcagtaagtgtctccaaacctctttcctaattctgggtttgggtttgggggtagggttagta

SEQ ID NO: 72861 - DNA, 201 bp, Homo sapiens; identical to SEQ ID NO: 60437

SEQ ID NO: 72862 - DNA, 201 bp, Homo sapiens
ctgggattacaggagtgagccactgcacctggccttctcttgtgtcttttgtctttcatttctcttcttcactacccgtcagcatgataggtttcttcctrctcttatgaatcccagtgtcaagatacagcctgatcgccccttaatacggtgccgccattactccagacccctctgcaagcattggtcattcatcagctt

SEQ ID NO: 72863 - DNA, 201 bp, Homo sapiens
cataagactgctgtgaggggagattgaagcttgattatctcagcagccaactttcatattcagctttagcttagccagagtttcattgtttttaccacccrtagtgacgggctagggtggaaaatgagtctaaattgcaggccttttagagtgcgctttcccaggatgggaccttgccacctccccaaggggatagttttt

SEQ ID NO: 72864 - DNA, 201 bp, Homo sapiens
gcacctgggtccccagagcaagaggacgtactggggaggcagtgatgggaagatgtctgtctccttgagagcatgggatgcacaagctggggagaatgtcyacagctactcccagcatcattcattcatcaggtgtttattgagtgcttgctgtatgccagacctggtgccagggatcctttgaataagaaagacacggtc

SEQ ID NO: 72865 - DNA, 201 bp, Homo sapiens
gcgcccgtgccgcacctgttgtttgtcctgtctgctgaaacagaaagcagcctttgggtggcgggggctcttctccgagcatgagttctcaccctggctcsctgctgggcttggggagcctcttctggaagccttgggccaaggggcacagctttgtctcagggtagaagcctgatcacagactgagtggaggcccaagct

SEQ ID NO: 72866 - DNA, 201 bp, Homo sapiens
tctttgttgtgggggcaccctgagcattgtaggaagcggtcagcacccctggcctcgacccctaatgtcagcagcacccccacccgcacctcatattcctygttgtcagttgtgacaactaggaccgtccctaggcattttccagtgtcccctgggggcacagttgtcctggttgggaatcgctgttctagtggcacctct

SEQ ID NO: 72867 - DNA, 201 bp, Homo sapiens
ctgactcatttacaagcagcgcagcccactcttctccatcctaaaacgcctcccacctccctgcccttttttaaaacatctagtaagtcctggcagctgcrtggggagggacacacacacttaagggatacaaagagtcctgccttgcggcctgcctccccacccccatgatggatggaagctgtctgccctagcgccgtg

SEQ ID NO: 72868 - DNA, 201 bp, Homo sapiens
tgtagtctggcctcatcctgatttcgggggtctttcgatgctgtatagccctgcatcccctccggtgtgggcccgggcagacgtgcacacctccgcacacycctctggctcactcaccaccgttcatgcctctgctgtgctccgtgtctgttgctccttccatgtggggcggggtgtcctccttcatccccatgatacccc

SEQ ID NO: 72869 - DNA, 201 bp, Homo sapiens
tttcgcccctggttccccccacggcagcccctgatgtgtctctgctccaccaggtgaccatggccgaccgggcggcagctgagagggcttgcaaagacccmaaccccatcatcgacggccgcaaggccaacgtgaacctggcatatctgggcgccaagccgcggagcctccagacgggtgagagcttgtgttttcctgcct

SEQ ID NO: 72870 - DNA, 201 bp, Homo sapiens
actcaccaccgttcatgcctctgctgtgctccgtgtctgttgctccttccatgtggggcggggtgtcctccttcatccccatgataccccgcaggtcagawgtcctcctttctgtgaagcattctcaggtcagaactaattctgaccaagggacccaaggcagttatcctggcgttaaagtcctggggtgttaaaaggggg

SEQ ID NO: 72871 - DNA, 201 bp, Homo sapiens
gcatcagcgtggggttttgagttgagatttcagacaccctctgggaaatgcggcaaccttaggggaaagggagtccccagctgcgctcacttctgctgcgrggaacggcagcctctgtgagccctggtgggcagagtttgaatgtgtttttccttgcttccctcattcccatcttcaaaatccccagtgctttctggcctt

SEQ ID NO: 72872 - DNA, 201 bp, Homo sapiens
tgcagtaggtgctcattaagtattcataagtttgatggcatcttctacttcaaagagatactagtgtaatcttggctctttgtttcactaaatgtcaagcrgtcctgccattaaatattgactgcacaccctgttaagagctgctttcgttgaaagtaaagtatataaacctcatggagaagacaaattgtgttctttcac

SEQ ID NO: 72873 - DNA, 201 bp, Homo sapiens
aggtgcactcggttcctgtcatgtttggttggaagcaggatggagctgtggtgggtttgtgtgagacacctgtctgtgagcctgtgctcacgtgtgtgcargtgtgcatgtgagcctgcctgtgaaaaccctctcagtcaaaggggccagctgaacccgcctgcctcaccccgttttcgggttagcttcacaccagagatc

SEQ ID NO: 72874 - DNA, 201 bp, Homo sapiens
tttttgtatggtttaggatgagttcttagcttcggtgacctcaagtactaagccataactgcacttgaggtctccccaaaatgggagggatgattatattwattatatttgaaataaccttataacattgcaattaagaacagggggctgggtgcggtggctcatgcctgtaatcccagcactttgggaggccgaggcagg

SEQ ID NO: 72875 - DNA, 201 bp, Homo sapiens
tggttgccaaagggtggagacccaaacagggacggtgtcagaggggccatccgctcttggcttcctgggagatctgaactcaagcctctgagaatcgcgcrgcctcctgcccctgcctgggccttactgaggtgggtagggggaggctcccgggtgcagctccagggaggcagcggggcaggctgcctgggtcagctgtct

SEQ ID NO: 72876 - DNA, 201 bp, Homo sapiens
tcctgagtagctgagactacaagtgtgcaccaccacaccaggctctgttttttatttattttttatttttttgtatttttggtggatacagggttttaccytgtgtgcccaggctgatctcaaactcctgcgctcaagcagtcctcccgccttggcctcccaaagtgctggtattacaggtgtaagccaccacacccaggc

SEQ ID NO: 72877 - DNA, 201 bp, Homo sapiens
cactgcagtggcgtgatctcagctcagtgcgccctctgcctcccgggttcaggcgattctcctgtctcagcctcccaggtagctgggattacaggagtgayccactgcacctggccttctcttgtgtcttttgtctttcatttctcttcttcactacccgtcagcatgataggtttcttcctcctcttatgaatcccagtg

SEQ ID NO: 72878 - DNA, 201 bp, Homo sapiens
aacttcttgggagtcttttattattttataatacaaagtgaaacaaagccagaggagctgtttgcaggtgatggcgtgtgtgtgtgtgtgtgtgtgtgtgaacgcacgcacacgtgtgcgggcgtgctggggaaggctccactgaggatggcggaaatgggccctgttggcttctggggaagagcgagcagcccaggccca

SEQ ID NO: 72879 - DNA, 201 bp, Homo sapiens
agtttgccacttggactacactcctttccctaggggatgagggctcagctttcaatgtgagctgtgttgtttcccgaggttgcagtaacaaatggccacargcttagtggctcagaaccacaaaagtgaatcctcttatagttctggaagcctgacatccaaaatgactattaggggactaaaatcaaggtggcagcaagg

SEQ ID NO: 72880 - DNA, 201 bp, Homo sapiens
agcggccagttttgtcggccttgggctggcagcgacttgctgttggctgagggcatggagggaggtgggagccaggagcccaggcagctgagggttgtcckccagttaaccccttccgtgcctggctgaactcttcctcgactttctgaccccgaccttttataccttgccctggacaactctgaagatcccacagctctg

SEQ ID NO: 72881 - DNA, 201 bp, Homo sapiens
caacttcttgggagtcttttattattttataatacaaagtgaaacaaagccagaggagctgtttgcaggtgatggcgtgtgtgtgtgtgtgtgtgtgtgtctacgcacgcacacgtgtgcgggcgtgctggggaaggctccactgaggatggcggaaatgggccctgttggcttctggggaagagcgagcagcccaggccc

SEQ ID NO: 72882 - DNA, 201 bp, Homo sapiens
tccacatttttagcaaaaccttgcggggagatgtctgaggcaggggcatcactgcccatgtttggagaaggtgtgtgggttcaaagcttccatagcctccwactaaggaatgttttcgaggttctgagagctgggtcgggggggcactgatgatgccagggacagcctgctgggcacagccccaagacagtccttgctgtg

SEQ ID NO: 72883 - DNA, 201 bp, Homo sapiens
ccccgatctcgtgctcacattctgtttgtgcactcgtgggcccacatggtgatgcgtgcagttaaacaggaagctggcggaatgagtgcctgcgtggggarggaacagttccgcgtctcgagtacagtggtggggagatgtgtctgtgtgtgtgataaagcttcacagtttgtgtgtaactacacatgacatgtaagaatg

SEQ ID NO: 72884 - DNA, 201 bp, Homo sapiens
ggaggccgctccctgtgttacttgaagcatggcacttgccactgtcttcggtgagggggcgtttccctctggtgctggggagccagggcatccatttgggccttcatgtcatctcttgggacttcacgtacctcgaatccaacctgtgggccccttcggtggggctttgctgtgagagtaccttgactggtgtggaaggcc

SEQ ID NO: 72885 - DNA, 201 bp, Homo sapiens
gtggcagcatccggtgccagggcggagccgtctgcccctttcgcccctggttccccccacggcagcccctgatgtgtctctgctccaccaggtgaccatgsccgaccgggcggcagctgagagggcttgcaaagacccgaaccccatcatcgacggccgcaaggccaacgtgaacctggcatatctgggcgccaagccgcg

SEQ ID NO: 72886 - DNA, 201 bp, Homo sapiens
tcgccgcggacgcctgggctctcagctgctgaacaatgacatcgttttctccaggggttgaaatccatgtccatggctgacaacccaacaaggctgggacycaaattcgtacagagatgaggcagagtggagagaaacaactctggctgagccagagtctccagccactacttcttattcctgggctttagctcttcggct

SEQ ID NO: 72887 - DNA, 201 bp, Homo sapiens
gaggggacggtgacctgcccaaggacacacgtgagtcctgagaagagtcacaactcaggcctaggccttctgaacccagagcctggctctgctgccttggygcacccagagcaggcccgggagttctcacctttgaccagtcgtagctggaagcgtatgcaaatatgtttccattgtgattgaaacagcaagctgagatgg

SEQ ID NO: 72888 - DNA, 201 bp, Homo sapiens
gaggggacggtgacctgcccaaggacacacgtgagtcctgagaagagtcacaactcaggcctaggccttctgaacccagagcctggctctgctgccttggsgcacccagagcaggcccgggagttctcacctttgaccagtcgtagctggaagcgtatgcaaatatgtttccattgtgattgaaacagcaagctgagatgg

SEQ ID NO: 72889 - DNA, 201 bp, Homo sapiens
tcccctggctgctgtcttgccagcctcttacccgctacctctgtggctcttctatccttgctggctcttggctgaatgtggaggttccacagacatctccktaagccgctgcctcctccacccaagcacaactgatctcccatccactgtcgctcagccacgccctgtggactggagactcgtacctcattcctgtgctcc

SEQ ID NO: 72890 - DNA, 201 bp, Homo sapiens
ctcactctgtcacccaggctggagtgcagtggtgcaatctcggctcactgcaacaacctctgcctcccaggttcaagtgattctcctgcctcagcctcccyagtaactgggattacaggcacgcaccaccacacccagctaattttgtatttttagtggagacggggtttcaccatgtcggccaggctggtctcgaactcc

SEQ ID NO: 72891 - DNA, 201 bp, Homo sapiens
tcacggggccttggtgtgtgcacaccacggggcctggacagagcacctgggtccccagagcaagaggacgtactggggaggcagtgatgggaagatgtctytctccttgagagcatgggatgcacaagctggggagaatgtcaacagctactcccagcatcattcattcatcaggtgtttattgagtgcttgctgtatgcc

SEQ ID NO: 72892 - DNA, 201 bp, Homo sapiens
gggctcttgtaagcggcaccactggccttgccggaccccagcctaagcccttccctgcctccccatttccttttggttgaatccaaaaaaaacctggtccratctggcttcacttcctgccacccggtgctagcgccctggcctctccgttgttgagaactgattgccatcggcctttgcacagggccagtgcatgtggct

SEQ ID NO: 72893 - DNA, 201 bp, Homo sapiens
ttgtgagatgaactaagataacacacagaaagtgctgggctcatcctcacactgagcaggaattctgcgttccaagctcctgcaatttccattttctcacrcagcacacacagttgccagtcctccctcccgctccccagtgaggcctgagggacccaagtcacctctgcccagcctggctcccagcctagtctcacaaaa

SEQ ID NO: 72894 - DNA, 201 bp, Homo sapiens
gcgattccatttacctgcaaggattgacatgcacaatgagaagccaggcagaggggcgcagagaaggttccacccacgcacacttcctgcttgagttaggyaacaaagcgcacaggtacatttccttccagctgctgcccgctgatagcaagagaaactatccaggcttcctccatcaaatgccagcccagaacccaatct

SEQ ID NO: 72895 - DNA, 201 bp, Homo sapiens
ctgagcccaggagttctgtatcagcctgggcgacatagagagaccccatctctaattaaaacaaataaaaacggctatgaaaatatttaaaaaacaaatargtgatgtagcaatgtagacaagcaatgtcttcttcatcaatgcgttcaacaacaaggtcaagtagtggcgctgatgagactgtagttttttttttttttt

SEQ ID NO: 72896 - DNA, 201 bp, Homo sapiens
acgatgccagaggctgcttctcccttcgtcttgcctggcccctgcctgggtcctgccaggcttcccctgaactcacacggaagctcagatgaccagcttaygcagggtggatggccctccaagctttggccaggttgccacgactggaaggaggaagtggtaactccaaagttggcttctcctcggggtggtcggcttttc

SEQ ID NO: 72897 - DNA, 201 bp, Homo sapiens
gctctgtcgcccaggctggagtgcagtggcgtgatatcacctcactgcaacctccgcctcctgggttcaagcgattctcctgcctcagcctcccaagtagrtgggactacaggcgcccagctaatttttgtatttttagtagagacggcgtttcaccatattggccaggctggtctcgaactcctgaccttgtgatttgcc

SEQ ID NO: 72898 - DNA, 201 bp, Homo sapiens
tgaaatctgcaagctgacagagtcacacttacgggttcggggggttgatatagtgaatagcaactctcccctcgatacttcccagggcaaaaccagtaggrttgttctgtttgtctttaaaaatagccacacaccgatgctacagttaaaataaaaaagagacataatcacagcataatataagatttcatgactaacgtg

SEQ ID NO: 72899 - DNA, 201 bp, Homo sapiens
tcttttattattttataatacaaagtgaaacaaagccagaggagctgtttgcaggtgatggcgtgtgtgtgtgtgtgtgtgtgtgtgtacgcacgcacacytgtgcgggcgtgctggggaaggctccactgaggatggcggaaatgggccctgttggcttctggggaagagcgagcagcccaggcccagggtgacaggcca

SEQ ID NO: 72900 - DNA, 201 bp, Homo sapiens
acatctgtaaatacccatgaaactatcaccatagtcatctccccgaaaggtttttgtgtatattactgtaatcttcccttacgcacacacaaaaccatggytctgttttctggcattatggactagtctgaattttctagaattttatataagtggagccctacgctacattttcccctcgccccagcttctttccctcag

SEQ ID NO: 72901 - DNA, 201 bp, Homo sapiens
cagttatctccagtgcaaagtcatgatcacatatgattgatgttattagcttgctgcttgagttactgttcagaaaaactacactttgtatattatgagayttagtggtcactgttgagcaaaacttctagagctttcttggcatgcctgttgggaagagaataaaaatgtgtcatcagagtacaggtgacagagtgcacc

SEQ ID NO: 72902 - DNA, 201 bp, Homo sapiens
caccatctggctgtccagagaaagcatcgtcagcactctgttgtctggaacactgagcatggaggggtctgcctgtgggttccaactgcagtgcccgagaycagaacaaggagttgtggctcagtagtggcttgttgggaagacttttaaggaatatactcagtgtgattcggctgctgggcctctaatggtgttttgatt

SEQ ID NO: 72903 - DNA, 201 bp, Homo sapiens
gcagtatggctgcctcttagaaggggagggctggggtgggcttttccccaaggacagagctagggatgaaatctcagagggagagagtgcatcggcaggtmcaggagaaagctggaaactgagcctggaacacagccatggtgacaagacgggtgaagaaacaggatgcgtggtcaggaaggcgcggggctacaggagcat

SEQ ID NO: 72904 - DNA, 201 bp, Homo sapiens
atacgtgctgacaagacaggtcaggaagctgtgtgtcagctcagcaggaggtggtgatggtcccagtcagggtggcagagtggggacactgaggatagcasctgttcacaaggtatttgggaagtggaatagataggacttgttgattgattggctatggggagtggagaagagtgaagatacaaggactctcaggttctg

SEQ ID NO: 72905 - DNA, 201 bp, Homo sapiens
ggaaggcagccccgggtctcctttgacaaacacatcatgcttcccacctaaaccacctctgtgggtggggagctggggactggtctattagctttctcccyctgtcccccgagggtgcatttgtctgttttgcattttttccaggctgtagttagacaactcctggtcctggggggagcgctgcaaagagaaaatgtcagg

SEQ ID NO: 72906 - DNA, 201 bp, Homo sapiens
ttccagcaggcagtgcggctgccttttaccagcagtgtaggagcggtgggagagggctcctcaaaagggaaggagaaaaggtcatgggttctcactcggayctactgctgggggctgatgattaaaatgcaatggggcatgcaatggctttaatttacagagcccccggagactgggtggctctggagctgcatctgcatg

SEQ ID NO: 72907 - DNA, 201 bp, Homo sapiens
gcagaggaagggaaaggataagtgatgtgaacacagtgatattttgggaagatcaacgtaagagtgggatatatatatatatatatatatatatatatatcgattggaaagagaaattgggggctgagactttaaaaattatcatttatggatgctacacatagttcatgtattatctcacttaatccttaaaagagcctc

SEQ ID NO: 72908 - DNA, 201 bp, Homo sapiens
taatgacccggcatggaattcagggcgcctctcctgaaaggtcaggaaggagagaaatcaatgcctgcagacaaggagtccgtgcattgacaggtgccackggcactccttggccctcaccccatgtccccaggtccccggggagaggagacagacaggatgacctctcagacttggcagttatttctgatgagcagcctg

SEQ ID NO: 72909 - DNA, 201 bp, Homo sapiens
gtgagcagaggaagggaaaggataagtgatgtgaacacagtgatattttgggaagatcaacgtaagagtgggatatatatatatatatatatatatatatttatggattggaaagagaaattgggggctgagactttaaaaattatcatttatggatgctacacatagttcatgtattatctcacttaatccttaaaagag

SEQ ID NO: 72910 - DNA, 201 bp, Homo sapiens
ttccagcaggcagtgcggctgccttttaccagcagtgtaggagcggtgggagagggctcctcaaaagggaaggagaaaaggtcatgggttctcactcggawctactgctgggggctgatgattaaaatgcaatggggcatgcaatggctttaatttacagagcccccggagactgggtggctctggagctgcatctgcatg

SEQ ID NO: 72911 - DNA, 201 bp, Homo sapiens
ggatttttttttaaaaaagccttctttccactcataaatcaccctcctttgaaacccctcctccactttctctgctctctctctctctctctctctctctgtctctccaagagatcagcacattgcaaagacaggttgttgaatattttctctctcatcactaagaaggcctccctgctgggtgtaatcaagaaccataaa

SEQ ID NO: 72912 - DNA, 201 bp, Homo sapiens
tgtgagcagaggaagggaaaggataagtgatgtgaacacagtgatattttgggaagatcaacgtaagagtgggatatatatatatatatatatatatataaatatggattggaaagagaaattgggggctgagactttaaaaattatcatttatggatgctacacatagttcatgtattatctcacttaatccttaaaaga

SEQ ID NO: 72913 - DNA, 201 bp, Homo sapiens
tggatttttttttaaaaaagccttctttccactcataaatcaccctcctttgaaacccctcctccactttctctgctctctctctctctctctctctctcactctctccaagagatcagcacattgcaaagacaggttgttgaatattttctctctcatcactaagaaggcctccctgctgggtgtaatcaagaaccataa

SEQ ID NO: 72914 - DNA, 201 bp, Homo sapiens
aagcaactgaaaatgttgtcttcagaaaagttccccttcttcctccagcatcccattttctgggggcctaggatgtgtcatttaaaaccagagtgagcttsagaaacaacatgcagggtgaagcagcccagtgagagtgcccagactctacagggtgtggactgtgttacttactcactcattcatcccaacacatcatca

SEQ ID NO: 72915 - DNA, 201 bp, Homo sapiens
ccaccagatgctcagtgactgtccgctgggaggtgctttcagatccaatggtttaaaactctagttcccatgaattattaagaagcaactgaaaatgttgacttcagaaaagttccccttcttcctccagcatcccattttctgggggcctaggatgtgtcatttaaaaccagagtgagcttcagaaacaacatgcagggt

SEQ ID NO: 72916 - DNA, 201 bp, Homo sapiens
attttacagataaggaaggttgaggctcagatgacttaaggtcaaccctgcagggcatacagagctgggatttgaacctccatctgtctgacctctgatgvtgtttttggctatactttgctaccctgagcagttgtgtatcgagctgggggatgtaaagggaggagaagaaagaagatgaagagataccagccagcctta

SEQ ID NO: 72917 - DNA, 201 bp, Homo sapiens
cccaccagatgctcagtgactgtccgctgggaggtgctttcagatccaatggtttaaaactctagttcccatgaattattaagaagcaactgaaaatgttctcttcagaaaagttccccttcttcctccagcatcccattttctgggggcctaggatgtgtcatttaaaaccagagtgagcttcagaaacaacatgcaggg

SEQ ID NO: 72918 - DNA, 201 bp, Homo sapiens
cacagccactttttcctgagaaagaaacagagctacagacagttttactcattaaatactttttttccccttaaatctgtttttgtaattttttttttttagcgtgaacggaaaagtaaaacgggtgatattgaaataaacaaggcatttgtgatgggaaggttaaagcagattgttgggggtggggaagggggttggaaa

SEQ ID NO: 72919 - DNA, 201 bp, Homo sapiens
aagtcatgacacctccatcctatagcatggaggcaggagcccttgataagggtttcacacaggagagtggcatggtcatcctagaaggctcactctggtgrggtgtggactggagaaggagagactggaggctgagcagttgatgagctgagtaatgccaaaacccccaggcaaaaggtgataaggcctgggctgggtcag

SEQ ID NO: 72920 - DNA, 201 bp, Homo sapiens
gtaatgccaaaacccccaggcaaaaggtgataaggcctgggctgggtcaggaggtggaactggggagatgctcttaagaggtagaagcatcagtgtttggygatagactggacatggtggggtgggggaagggagtcactgagaaggacacctaggtttttggttacctgggtgggtagaagtcgtacgaggaagagcagc

SEQ ID NO: 72921 - DNA, 201 bp, Homo sapiens
tcagagcccacagtcagagcccacaaggaaggcagcagagggtggtcacttccctctctccctggctccagctctgggagcgaggagcctgacccctggcrtgaactcggctcttaccccaaccccaactcagagagtttgctggcagcagcctggatgactttggtgtagtttctgtggtttaataagctacaaaaacga

SEQ ID NO: 72922 - DNA, 201 bp, Homo sapiens
cctgctgagcagtgtagcaggggccaggaatagctggggatccatgtgtctaatcctctgggtggcaggaggaacctgggtggggttcttgggaagctttrgactttgaactctgatgtggcaaatgggtagagagttagaaacgtgggctctgaaactgactcagaaggaccatgaagtgcgagaagagttctgagggtg

SEQ ID NO: 72923 - DNA, 201 bp, Homo sapiens
ttttaattgagttgggaaaatatgggctattttataaatggcgttgggataatgggccagccatagcaacactccttattggggtaagaactctctgactrggtctaataagctcaagccatgaagaccacatggcataaatatgagtgaatattttgatcatcttaaggtggggaagattcttctaagtatgacgtgata

SEQ ID NO: 72924 - DNA, 201 bp, Homo sapiens
tgagttggaatcattttggaaggaactccccatcttcccagggaccatctccatttgtccacatgcctgctggttacactgcaccagcctcagtccccccsaccagacaccagcaccccacctgctgagcagtgtagcaggggccaggaatagctggggatccatgtgtctaatcctctgggtggcaggaggaacctgggt

SEQ ID NO: 72925 - DNA, 201 bp, Homo sapiens
agggaagtcctgtttcatgcccatggcacgtcagcaagcccttggcactttgcagaccagactacagcaaactccccaggaaacaaaaatgtctaattcgmgtgagagctcctgctttggggtctgctatagagtggggtgagtctgggatctgctggagcaggagccaaaaaaggaggcatcattcctgagttggaatca

SEQ ID NO: 72926 - DNA, 201 bp, Homo sapiens
cctcccttgggaggccgggagccaggactcagacaaagtgtgggtttcctctcaggtggacagcacgcctgccctcccgcctatgcagaggccacagagarattgcccaccagattcagggctctcataactctttcaagacaatcactttatttatatgactttgtttaaaaaacccacagacgatccaccacggggaca

SEQ ID NO: 72927 - DNA, 201 bp, Homo sapiens
ctcagagaggtcaagtgatatccctgaaatcacacagtggggaggtaatggagtcaaattccattctgctttactccacctccctccccctttccccccayttagacgcttgggtgtatgaaagtgctagtctgagctgggtgttacagtttcctggtgtgcaagggccctgtctagaagcttctgtgagaccatgaggga

SEQ ID NO: 72928 - DNA, 201 bp, Homo sapiens
ttttccttgtcattccccgcaatagccctgagtatacactgttgtctccaggaggaagcaggctcagagaggtcaagtgatatccctgaaatcacacagtygggaggtaatggagtcaaattccattctgctttactccacctccctccccctttccccccaattagacgcttgggtgtatgaaagtgctagtctgagctg

SEQ ID NO: 72929 - DNA, 201 bp, Homo sapiens
atctccaggaatcatctacttaaactatcttcctttacatcctacaggatgagtaggagttatcaggcaaaggaaagcaaaagatggaagagggaaaagayggcattccaggcaggagacatagtgtgaacaaaggcatgggtggaggcacggtgcagtgaacattaagcaggttgacattgaagattaaagaccaatgtg

SEQ ID NO: 72930 - DNA, 201 bp, Homo sapiens
tctgtgcatttctgcctgtatctgcaaatgtctgcttgtgcactgtccatgcaggtaggtccacactggtgtgtgtctgatgacctctgtcagtatctgcygacatgagtctgtgctttctgttagcatctgtgcaagtgtcatctacgtctatgagcatgtttgttctttccagtgcctctatgtgtcttgtacctgtat

SEQ ID NO: 72931 - DNA, 201 bp, Homo sapiens
caagggaaggaaggacagaggaggggccgctggacagagctgtggccatagaatagctcagccagtgcctgaatgcagtgagtcagagaggagatgggagycacattcccaacctctctcttttcctgcccttgattccttgctggtgccacatattagctggcctggactggaagccagagggtgggagagcctgggaga

SEQ ID NO: 72932 - DNA, 201 bp, Homo sapiens
catgtgatgctcagccctgggatggcctcagaaagggctcgggtcctgtcctggactccagctgcagctggccacagtccctacccctgctgtgagggccmgagtgtgccctccaggaggagaccttggagagtggcagtgacgtttctctgagggcactctggccctgggatgctcttgttttcccctccatggccccca

SEQ ID NO: 72933 - DNA, 201 bp, Homo sapiens
ttgattggctatggggagtggagaagagtgaagatacaaggactctcaggttctggcttggtgatattcactgagatgggacacacaggaggagagagggyttttttgggaacaaagatagctgagttttagatctggtgagtttgaggtatcaatggaacagtgtgtaatgtctcattcattcattaattatttactgag

SEQ ID NO: 72934 - DNA, 201 bp, Homo sapiens
ttggcctcttggggccttcagggatgaaggtacagcagctcacgccaccccattccacactggcctctgaggtcaacatggaaattctcaggcaatgatgstttcctgcaattcatggcctgggacccaccaatacatcttctcccgctctgctctcccgtttgtcaaggcccacccagatcctgctccaagctctaggtg

SEQ ID NO: 72935 - DNA, 201 bp, Homo sapiens
tgggcaaatgtaagaatgttgcaaagaggcaaattttggctcagttcaaggaagaactttgaaagcaattgcagatgtttaacccatgaaggaggtggtayaggaatttgagttcccagaggcctcaagcagaatgtggacttagcaggaatcctgcagaaggaagccaggttctaaggggttgtcatcatagatttctgt

SEQ ID NO: 72936 - DNA, 201 bp, Homo sapiens
caagctctaggtggaagcccagaaggcactggagcatttgctagtcattggctttccggggaaagaaataatccttgtttggggtccaattccttggggaracattactccctttctaggaaggacaggtccctagtttcctttgtctcttcccaaagaggcaccaagaactctggcagaggggtcagaattaccagaatt

SEQ ID NO: 72937 - DNA, 201 bp, Homo sapiens
ttaaggctgacaaaacccaggcttgatgagggtctggactaatgtgtgggcacggttgatgagaattttgctgttgtaagctttctgaaggacagagtggraaaatagaaatagcatacccttaattgcagccatctcatttattggattttattctaaggcaattgttgcaaaaatgagcaaagagaatatgcacaagga

SEQ ID NO: 72938 - DNA, 201 bp, Homo sapiens
ctagagacctttgcagggtcctaaggagaaagaaggtgactataatatccagaggaccttgaatatcaagacttggcattagaatcatgaaatgttaggartaaaaagatctccaggaatcatctacttaaactatcttcctttacatcctacaggatgagtaggagttatcaggcaaaggaaagcaaaagatggaagagg

SEQ ID NO: 72939 - DNA, 201 bp, Homo sapiens
cctctcccagcccagaggagtcaatttctccaagtgtcctgggcttcagtgagaaaggcagtggagaagggagctctcgtttattaagggcccaccaagtyctacgcctgtaatatgggtgagctcattcagtccttatggcaaccctgggtggtaggagctattttacagataaggaaggttgaggctcagatgacttaa

SEQ ID NO: 72940 - DNA, 201 bp, Homo sapiens
ccccaccagatgctcagtgactgtccgctgggaggtgctttcagatccaatggtttaaaactctagttcccatgaattattaagaagcaactgaaaatgtagtcttcagaaaagttccccttcttcctccagcatcccattttctgggggcctaggatgtgtcatttaaaaccagagtgagcttcagaaacaacatgcagg

SEQ ID NO: 72941 - DNA, 201 bp, Homo sapiens
gcttgagcccaggaggtggaggttgcagtgagccaagactgcaccactgcactccagcctgggtgacagagtgagaccctgtctcaaaaaaaaaaaaaaattattcactgacttttcttaggcatgcacttggctctatctcagtgtgtgaagagatgcagcatgtgatgctcagccctgggatggcctcagaaagggctc

SEQ ID NO: 72942 - DNA, 201 bp, Homo sapiens
atgaggctgcccctctcccagcccagaggagtcaatttctccaagtgtcctgggcttcagtgagaaaggcagtggagaagggagctctcgtttattaaggmcccaccaagtgctacgcctgtaatatgggtgagctcattcagtccttatggcaaccctgggtggtaggagctattttacagataaggaaggttgaggctc

SEQ ID NO: 72943 - DNA, 201 bp, Homo sapiens
gaggaaggaagagagagagagaatgggagatagaaacaagagtgaaagaaagccacagtgaccgagaaatagaattgggacaaacgaaccaacagacagamattctgactctattaccaggcacttcttaaagatcactgttggccaggcagtggctcacacctgtaatcccagtgctatgggaggccgagatgggcagat

SEQ ID NO: 72944 - DNA, 201 bp, Homo sapiens
cgcttgagcccaggaggtggaggttgcagtgagccaagactgcaccactgcactccagcctgggtgacagagtgagaccctgtctcaaaaaaaaaaaaaatatattcactgacttttcttaggcatgcacttggctctatctcagtgtgtgaagagatgcagcatgtgatgctcagccctgggatggcctcagaaagggct

SEQ ID NO: 72945 - DNA, 201 bp, Homo sapiens
ttccctgccttgtggatatgagctgctgttcagagctccctttcccccgtgtgcttataagggacccctgccagtatctctgcctatcgttctctgagtcyttttttgtttagcaaatgtttcctgggctttctgtgtgcttggccttctactgaactctggggcccagagactaggagaacagttagctcatcccttcca

SEQ ID NO: 72946 - DNA, 201 bp, Homo sapiens
cctcccaaagtgctgggattacaggcgaaaccctgtctctactaaaaatacaaaaattagctgggcgtagtggcaggtgcctgtaatcccagctacttagyaggctgaggcaggagaatcgcttgaacccaggaggtggaggttgcagtaagctgacattgcaccattgcactccagcctgggtgacagagcaagactctg

SEQ ID NO: 72947 - DNA, 201 bp, Homo sapiens
atcactgcattccagcctgggcaacagagtgagactccatcttaaaaaaaaaaaaaaaagtcaggctggtcttgaactcctgacctcaggtgatctgcccycctcggcctcccaaagtgctgggattacaggcgaaaccctgtctctactaaaaatacaaaaattagctgggcgtagtggcaggtgcctgtaatcccagct

SEQ ID NO: 72948 - DNA, 201 bp, Homo sapiens
accccatctctactaaaaatacaaaaattagccaggcgtggtggcgggcgcttataatctcagctactcaggaggctgaggcaggagaatcacttgaaccyggggggtggaggctgcagtgagccgagatcacaccacttcactccagcctgggcaaaagagcaaaactccgtcttgggaaaagaaaagaaaagaaaactg

SEQ ID NO: 72949 - DNA, 201 bp, Homo sapiens
aaaagattgataaatttgactatatgaaaattaaacatttaagtaccttaaagaacattataagaaaattttaaaagaggggtatatacatatgtatgtgmatatatatatatatatatatatatatatatatatgacaacagtttaattttatttctaatgtacaaagagctcttacaaatcattaagaaaaagataaat

SEQ ID NO: 72950 - DNA, 201 bp, Homo sapiens
aatgttttataaaggcacaatataattaaaattcttgtctaggaatagacagacagatcactgggacagactagagtctagaaatgggcccagatatttatgggaatttttgtttgtttttggaacagagtatcactttgttgcccaggctggagttcagtggtgtgatcttggctcactgcagccttggcttttcgggct

SEQ ID NO: 72951 - DNA, 201 bp, Homo sapiens
atgtctcctctcttctcacctgctgagaggtccttctgggcagggactcgggcagattcattcctgcctgccccacatttccctagcccagggcctggccrgttgcagtgctgaaggatgattctggtaagaaacaaggtactccagctcacatcttgcaatgattatgcctcccccactctcccttctccttgcagttct

SEQ ID NO: 72952 - DNA, 201 bp, Homo sapiens
aaagattgataaatttgactatatgaaaattaaacatttaagtaccttaaagaacattataagaaaattttaaaagaggggtatatacatatgtatgtgtytatatatatatatatatatatatatatatatatgacaacagtttaattttatttctaatgtacaaagagctcttacaaatcattaagaaaaagataaata

SEQ ID NO: 72953 - DNA, 201 bp, Homo sapiens
ggcgctgggaggagcagagccaggtggaacccaagtgggtgggtggaggttgcccctactgggttctggttaggggttttggcttcttgagggcctgaagrgtggcagggaggggagggaggacaaggagggggaggaaggaagagagagagagaatgggagatagaaacaagagtgaaagaaagccacagtgaccgagaa

SEQ ID NO: 72954 - DNA, 201 bp, Homo sapiens
agcttcgcacagagcatgccgtcgagacatctttgcataatgagtgaacggatccatctgtgagccgagaccttttctggccatgctccttttctgtgggrtcagagtcccaaatccagcagggaagtgggggcagacagcatttgccccagggctaaaggccataaccctgctctccagaacattacctggtagtggctt

SEQ ID NO: 72955 - DNA, 201 bp, Homo sapiens
ggaagccaggttctaaggggttgtcatcatagatttctgtggttccatgagtcctggaagaggggctccttggctgccccatagtggtactcctccctcayaacctgtggcctagcttgtattgctgtgtacggcagccaggcggacttggaatgcttgaaatgagcagtctgcgaaggtaagatgtgaacacacgaatat

SEQ ID NO: 72956 - DNA, 201 bp, Homo sapiens
aaagcacagggaagcaagtgggcctcacccaggagcttcgcacagagcatgccgtcgagacatctttgcataatgagtgaacggatccatctgtgagccgwgaccttttctggccatgctccttttctgtgggctcagagtcccaaatccagcagggaagtgggggcagacagcatttgccccagggctaaaggccataac

SEQ ID NO: 72957 - DNA, 201 bp, Homo sapiens
aggcctcttgagtcataatctgcattttcatcccacaatctgtatttgaataggatccccaggtgatctgtacatccattaaagcttgagaagagtagagrggtgcttctccacataagcaggcaacagaacgtgttttaacaaaccctctggggtgattctgttgcagaatttctgattcagtaggtctggggtggtgtc

SEQ ID NO: 72958 - DNA, 201 bp, Homo sapiens
gctggatggactacagtgccttccgggcctgcatccttttaagctttgcatcagcttgcagaaacccacagggatgcaatcactgtgcctcaaagttatarcaaggcaaaacccaacgatgagaaagaggaaatgttgaggcagtttgggggagccctggatttttttttaaaaaagccttctttccactcataaatcacc

SEQ ID NO: 72959 - DNA, 201 bp, Homo sapiens
gcagacagggggaaaagggagtggaggcgggggtgttggggagggaaggtgggatggaaggggagaggacagcttagtcacctgggaagatcatgtccctrgagagtctgccctgtcattgtcttagggtcttgattttcctgactcttgggctaggccagggatggggctaataaagggaacaagaaacatacagaactc

SEQ ID NO: 72960 - DNA, 201 bp, Homo sapiens
tttatgcccaattaccctaagtcaagggagaagaaagtgctggtctctgaatgttctggaacggggagagctcctggttccctagttcctactggccaggrgtatccattccttttccagctgtctccttcccttcttagagccctttttctggtggtcagtggcttgccagggcctggccaggctggttctcctatgctg

SEQ ID NO: 72961 - DNA, 201 bp, Homo sapiens
tagatcccaggttaaaatggccagttacactcttttcgaggacaaatattccactctgtgaaaacagagcacaaaccttggcttctcctcctgcacactgyagggtggggttgggggaggtgtttgtgcatatttttgcagggctgtcctgggggtggagataaatgtctgagaggcagagtttggaaccctaggaggatg

SEQ ID NO: 72962 - DNA, 201 bp, Homo sapiens
tgaaggtcatgtgctattttctgtttttccagttctctccctttcttttcaagttattaggggaggcagagtccttctggagtttgacccttggattccarccagagcagcctccaaaatgacacctttgaaggtgggaaagacactgcatattctctgggtttttgtttgaggtctgtcttggatttgttctttatgccc

SEQ ID NO: 72963 - DNA, 201 bp, Homo sapiens
atgacaaatagctaattagggtcaaaagaagcactctgaaccaattagttgtagggtctatccctttctcctgggagaagactgggccttcctgctccctwcccagcactgactcccaaatgcccacacactctggcatcctgtctggctggggccctgactgtgaagagcactgaaacagacgtcagtgcatgggcctca

SEQ ID NO: 72964 - DNA, 201 bp, Homo sapiens
ctccctgccccgtggctgcaagcatatccgaggctaaggcgggccttccaggaggctcacactcagccaggcttctctgtggaggtaagggcaccagaacscggaataaacttgtactaaggtaggtattttagctggtgctggaaagttgggggaggattagctaccagaagagcacgggccgggcactgcaggcccagg

SEQ ID NO: 72965 - DNA, 201 bp, Homo sapiens
gtggagaggaatctgtgatttattgagcaccaactgtgtgctggatacttcacacgcatggttttatttaatcctcacaagcttgtggattaaacaagacytgacaatctccattttactgatgagaaactgagtctccgggaagtgacttgcccaaggtgggtggagctgggattcaaacctgggtctgtctgacccttt

SEQ ID NO: 72966 - DNA, 201 bp, Homo sapiens
ccaggaagtgtcacaagtgttgtgaggtgacagtgagggttagctggtccagctcaccttcagcctctggcctcaagtgacacagccgggtgcccttggtrggcagtcagagggtctcccccgggcactgggctctgcccttcctcggccccttcatgccagccccttttggtcagcgggtgcggcagacctcctccaaat

SEQ ID NO: 72967 - DNA, 201 bp, Homo sapiens
tgaagatgggcaccatggctttggagtttgagaccagcctggccgacagggtgaaaccccgtctctactaaaaatacaaaaaattagccgggcgtagtggygggcgcctgtagtcccagctacttgggaggctgaggcaggagaatggcgtgaacccaggaggcggagcttgcagtgagccgagatcccgccactgcactc

SEQ ID NO: 72968 - DNA, 201 bp, Homo sapiens
agccgagatcccgccactgcactccagcctgggcgacagagcgagactccgtctcaaaaaaaaaaaaaaaaaaaaatacaaaaattagctgggcatggcascacacacctgtaatcccagctactcgggaggctgaggcaggagaattgcttgaacccgggaggcggaggttgcagtgagccaagatcgcaccactgcatt

SEQ ID NO: 72969 - DNA, 201 bp, Homo sapiens
gatcaaattggccgtttctagagcacaggcacttcgtagctgttgaccatcatttagctccacgtctgcccgtcggttcctcgtgcgtggaatccagcacsacgtgggtgtctctgccgagctctcggcatttcctgagccctcccggaagccagactctgttctcggcgcttcacacgggccgtctcgtctgatgctgtg

SEQ ID NO: 72970 - DNA, 201 bp, Homo sapiens
gatcaaattggccgtttctagagcacaggcacttcgtagctgttgaccatcatttagctccacgtctgcccgtcggttcctcgtgcgtggaatccagcacyacgtgggtgtctctgccgagctctcggcatttcctgagccctcccggaagccagactctgttctcggcgcttcacacgggccgtctcgtctgatgctgtg

SEQ ID NO: 72971 - DNA, 201 bp, Homo sapiens
ctctcggcatttcctgagccctcccggaagccagactctgttctcggcgcttcacacgggccgtctcgtctgatgctgtggcgtcctgcagggtgggaacyggcggtgcccgtggacgtggcgctgtgcctgccggcgtcctgggcaccacagcgttgccgcttgcccactgcctcctagcatggccaggtgaggtcgggc

SEQ ID NO: 72972 - DNA, 201 bp, Homo sapiens
ccagaggcacctgccctctctggttgcttagaatattctagaaggggcaggggtcctggcgctcctctgtcctccacatcctctgagtgttctgagcatcytgggctgctttggtgttttctactcccctgctgccctctggtcctgccaccccgagctgacaagcctgccttctgctggctgccttcaaccactcagaga

SEQ ID NO: 72973 - DNA, 201 bp, Homo sapiens
gatcaaattggccgtttctagagcacaggcacttcgtagctgttgaccatcatttagctccacgtctgcccgtcggttcctcgtgcgtggaatccagcacracgtgggtgtctctgccgagctctcggcatttcctgagccctcccggaagccagactctgttctcggcgcttcacacgggccgtctcgtctgatgctgtg

SEQ ID NO: 72974 - DNA, 201 bp, Homo sapiens
gtcacacaaccggaggcggagtgtccgtctagtactgggacccggtgtgatgctttaaggaacacacctgccgtccttatgtgagctgggctgggcctttmtttttaatggacacataattgtaatatttatggcatatatagtgatgtttagatacatacaatgtatagtgatcagatcagggtaattagcacagccatc

SEQ ID NO: 72975 - DNA, 201 bp, Homo sapiens
tacaactataaacgcttagaagaaaacgtaggtgtatattcatgaccttgagtcaggcaaagatttcttagatacaacaccaaaagcacaaccaataaacraagaaacggataagctgaacatcatcaaaattaaaagaaaaaaaaaacctttgtgcttcaaaaggtaccataagtaaagtgaaaatacaaggtacggact

SEQ ID NO: 72976 - DNA, 201 bp, Homo sapiens
acgtgcccatctagagccttggggtgggcctgtgagagagtggccgcccaccccagtccccaccaggtgcatagtcctgcggctaagtcagggcggttgtracaaaggctcagaccctccaactaccaggctgtgttgtgacgaggctgctggagccccaggcaccatgacgggaatgggtgaatccacccacagtgggtg

SEQ ID NO: 72977 - DNA, 201 bp, Homo sapiens
tttctttttcttttttttttttttgagacacggagtctcgctctgtagcccaggctagagtgtggtggcgtgatctcggctcgctgcaacctccacctccygggttcaagcgattctcctgcctcagcctcctgagtaactgggatcacaggtacacaccaccaggcctggctaatttttatatttttagtagagacaagg

SEQ ID NO: 72978 - DNA, 201 bp, Homo sapiens
tgagaggagcacccccagaagagaaagtgctgaaccagaagcccaggagagtcatgtgtgtgcgtgtccatctaagcctttgccccaaaacagtaggtagrtcaggtgcagtggctcatgcctgaaatcttagcactttgggaggctgagatgagaggatcacttgaacccaggagttcgagaccagactgggcaacatag

SEQ ID NO: 72979 - DNA, 201 bp, Homo sapiens
agaatggtggcagaggcgagctggggagcagggaggaaccaggctgtcgcaggagaaacagaatattgcgagccagccgtgtggaatggaaaggggaagcyggtcttcctgccccacactcctgcctttcttccttaagggctccttggacagagactgcaggtttctcagaagcactgtccaggatctcaacattctaga

SEQ ID NO: 72980 - DNA, 201 bp, Homo sapiens
gggggctgaggtccccactcccctttcccttcctcctcagcacagcttcccaaacaagccccatgctgagcggcgcccccagactccctaagcttgtcctrgggggtgtgcatctgtgtagccccgtctccagctggaggacttggcctgggctgtcacagcagctgcaagtgcaggctgcaccccagccctccgccccgt

SEQ ID NO: 72981 - DNA, 201 bp, Homo sapiens
ttcctcccctgccagcagctcagccctgatcatctctcacctgaggcccttaaaagcctcccaatcagcctctctgcccccgacccccaggcctgcacccsgtcctctcccgcactgcagcccagcgctgtctaactgagagacctgggttacatttcagcatcccccatgtgattccctgctgtccacaccagcaagtct

SEQ ID NO: 72982 - DNA, 201 bp, Homo sapiens
ctgaggcccttaaaagcctcccaatcagcctctctgcccccgacccccaggcctgcaccccgtcctctcccgcactgcagcccagcgctgtctaactgagmgacctgggttacatttcagcatcccccatgtgattccctgctgtccacaccagcaagtctctgagtgcaacccgcagccacgtgcatcataatcagctga

SEQ ID NO: 72983 - DNA, 201 bp, Homo sapiens
tgagcataataatccccccggacctgaagcccacgaatgacccccccacccagtcctttctccctcatgtcacgtcaagtgctgtgtcactgaagcacccygtaccccatcacctggtgccagaggcctggccatggtgcagctggacccccagctgccgtgtgaccgtgggcaaacggattatgtcaccttcccagtgtt

SEQ ID NO: 72984 - DNA, 201 bp, Homo sapiens
aataactttcccagcttacacggaggagctgggtttgaatccagacatcacactgatcagcacgcagacccgcagggtttcatactcttccggcatttcasgtacacctctctccatctcaccgcctcaccataggaggtgaggcctattcctatccgcacaatctgacagggaaattgagactcagagaggttaagtaac

SEQ ID NO: 72985 - DNA, 201 bp, Homo sapiens
ggggtcctggcgctcctctgtcctccacatcctctgagtgttctgagcatcctgggctgctttggtgttttctactcccctgctgccctctggtcctgccmccccgagctgacaagcctgccttctgctggctgccttcaaccactcagagaaaccacagctcccccctccgcagaagccgcgctcggagcagcagaagga

SEQ ID NO: 72986 - DNA, 201 bp, Homo sapiens
ctattcctatccgcacaatctgacagggaaattgagactcagagaggttaagtaacttgcctaaggccacatagctcgtaatcagggcagcagggattccrggccgagcaggcaggcccctgatccaggctcctagcctgctgcccagggaggtcagagctggaaaccacttccacagcacaaggagactctgcttggact

SEQ ID NO: 72987 - DNA, 201 bp, Homo sapiens
ctggcgctcctctgtcctccacatcctctgagtgttctgagcatcctgggctgctttggtgttttctactcccctgctgccctctggtcctgccaccccgmgctgacaagcctgccttctgctggctgccttcaaccactcagagaaaccacagctcccccctccgcagaagccgcgctcggagcagcagaaggaaggcga

SEQ ID NO: 72988 - DNA, 201 bp, Homo sapiens
cctatccgcacaatctgacagggaaattgagactcagagaggttaagtaacttgcctaaggccacatagctcgtaatcagggcagcagggattccaggccragcaggcaggcccctgatccaggctcctagcctgctgcccagggaggtcagagctggaaaccacttccacagcacaaggagactctgcttggactgtgct

SEQ ID NO: 72989 - DNA, 201 bp, Homo sapiens
atagctcgtaatcagggcagcagggattccaggccgagcaggcaggcccctgatccaggctcctagcctgctgcccagggaggtcagagctggaaaccacytccacagcacaaggagactctgcttggactgtgcttggcctcacgtgacctctgacctccctggccctcctgtgaccctgacaggtgtgctgagcttctg

SEQ ID NO: 72990 - DNA, 201 bp, Homo sapiens
ccctcccctcttgaaaaagaccatctgctgggtgcggtggctcaagcctgtaatctcaacactttgggaggccgaggtgggcggatcacgaggtcaggagmtcgagaccatcccggctaacacggtgaaaccccgtctctaataaaaattcaaaaaaattagccgggcatggtggcgggcgcctgtagtcccagctactcg

SEQ ID NO: 72991 - DNA, 201 bp, Homo sapiens
gcacgccaccacacccagctaatttttgtatttttagtagagacggggattcaccatattggtcagactggttacaaactcctgacctcaggtgatccacycgcctcggcctcccaaagtgctgggattccaggcatgagccaccatgcccagcctgcactgggttttggactggctgtgttagcatcacctggggcaggg

SEQ ID NO: 72992 - DNA, 201 bp, Homo sapiens
gagggctgcccaagacagtgaataacctggccagagatgtcagtagtgccgagactgacaatcccacccaaagggcaagggttaggattcaggtagggatkgaggggcacaaagggcagcccttggaaacaaatattgagaagagcaggtggaagtaaaagaggaagtctgggcctctggagggagaattgatcgtaaagg

SEQ ID NO: 72993 - DNA, 201 bp, Homo sapiens
ctgaggtgggagaatcgcttgggccaggaaattgaagctgcagtgatctgtgattgcaccactgcactccagcctgggtgacacagcaagactccgtctcaaaacaaaaaaaaaattatatttggagtacaactctgaatccatatgctaactattcataacattcttagcaccgaggctgtactgggcacccctccggag

SEQ ID NO: 72994 - DNA, 201 bp, Homo sapiens
caacggaactgcccaggggcacggggcaaggctgagcagccaggaagtgtcacaagtgttgtgaggtgacagtgagggttagctggtccagctcaccttcrgcctctggcctcaagtgacacagccgggtgcccttggtgggcagtcagagggtctcccccgggcactgggctctgcccttcctcggccccttcatgccag

SEQ ID NO: 72995 - DNA, 201 bp, Homo sapiens
cctgctctagtcctctaggtttggaggccacgcctctcccaacggaactgcccaggggcacggggcaaggctgagcagccaggaagtgtcacaagtgttgygaggtgacagtgagggttagctggtccagctcaccttcagcctctggcctcaagtgacacagccgggtgcccttggtgggcagtcagagggtctcccccg

SEQ ID NO: 72996 - DNA, 201 bp, Homo sapiens
ggggtgggtcacgttagaatgagtcctggctaggcccacagcaggcttttccacccgaatactggggccacagctcatgaatctgtgtgtatccatatccygggctgggtcagctctccagggtggagatggttgggcaggcagcctctgggggcaagctcgggctcaggcctccccttgaccagcttcacagagacagac

SEQ ID NO: 72997 - DNA, 201 bp, Homo sapiens
cctgcaactgctgtaataaatgactatttttcatggccctgctctcagatcgctgtgggatccctaaatgtttgtgtgtaactaatctcgttgggcttcargatcacagtaaagacagcttagaaacatggaagctctccattcgggcagcacctccttcttttagcaggatggggccgacctcgccagctggagcagcag

SEQ ID NO: 72998 - DNA, 201 bp, Homo sapiens
gatctcagctcactgcaacctccgcctcctgggttcaagcgattctcctgcctcagcctcccgaatagctgggactacaagtgcgcgccgccacgcccggstaatttccgtatttttagtagagacggggtttcaccctgttggccaggctggcctcgaactcatgacctcaagtgatccacctgcctcggcctctcacag

SEQ ID NO: 72999 - DNA, 201 bp, Homo sapiens
tcaatgtatctgaggttgttggaagggagggagagagacagactctgaaaccatcctagtacagggatcagcaaactatggcacaaagggcagatgccgcycaccacctatttttgtagagtctcattggaacctggccacgccctttcatttacatctcatctgtggctgcttctgagcagctgcagtagagctgggtaa

SEQ ID NO: 73000 - DNA, 201 bp, Homo sapiens
tgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgc

SEQ ID NO: 73001 - DNA, 201 bp, Homo sapiens
ggaggctgaggcaggagaatggcgtgaacccgggaggcggagcttgcagtgagccaagatagcgccactgcactccagcctggagacagagtgagactccrtctcgaaaaaaaagaaaaagaaaagaagaccatcctagccatgcagccacttgccctccgtccctggtttgtgagcctgtgcgtgcaccgggggacagag

SEQ ID NO: 73002 - DNA, 201 bp, Homo sapiens
gaaccccaccctcaccacagatgggaacagacacagagagcctcagccccgcagtggtctcaggggcccactgaccaaaggtggccggaatcgcttccccrcctccacctgcagcccggcctctgccctggctggctactcatagcaggctgttgccatgggaacagcagagctgttgagctgtgacatcatggcaggggt

SEQ ID NO: 73003 - DNA, 201 bp, Homo sapiens
gtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgca

SEQ ID NO: 73004 - DNA, 201 bp, Homo sapiens
ctcctgcccctgccactgccacgtctgcctgtctttgcttccttcttatctcctcctccctgctgttgcatccctcctcgcagctgcctgggaagcctcgrgcagacctctttgttgtttccgaacccaagacgttcacccctacacacgacccccactgcatcgagtcagtggttctgcatcaggactggagacggctgc

SEQ ID NO: 73005 - DNA, 201 bp, Homo sapiens
atctccaacccagtcccaccagcttccctcactctccttcccatcacactgcctgtggggagccccgtggtgcagggactttgccgctggccttgcgaacmcacggcttggagcccctccttggcccactctccggggccctcttgggagcctcgctaaacagctgggcatggaaagaaccccaccctcaccacagatggg

SEQ ID NO: 73006 - DNA, 201 bp, Homo sapiens
tgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcat

SEQ ID NO: 73007 - DNA, 201 bp, Homo sapiens
ctgcaaacctcaagatcctaagcacccagcctaggtcaggggtccccaatcccagcaggtgttcctgcttcctgaagaccccccagcccaactcctccaayaaccatattcatctccaacccagtcccaccagcttccctcactctccttcccatcacactgcctgtggggagccccgtggtgcagggactttgccgctgg

SEQ ID NO: 73008 - DNA, 201 bp, Homo sapiens
gttgaccatcatttagctccacgtctgcccgtcggttcctcgtgcgtggaatccagcaccacgtgggtgtctctgccgagctctcggcatttcctgagccrtcccggaagccagactctgttctcggcgcttcacacgggccgtctcgtctgatgctgtggcgtcctgcagggtgggaacgggcggtgcccgtggacgtgg

SEQ ID NO: 73009 - DNA, 201 bp, Homo sapiens
agtttcaaaatcaataaaaccgtgatgaaatgatcaggaataaacctgtccagaactgttcaagacctaaaggagatgcacgggctgaagaacaaggagcraatctgaacgagggagaggtgtgtcttcctggacagttctcgggagaggaggagggcggtaaggacggggagaagaggccgcaggcttggagtccaggag

SEQ ID NO: 73010 - DNA, 201 bp, Homo sapiens
cctgaaatgcttggggaagaggggtggtacttactgtgtgtgtctccagatgactgagctagaccacccagaacacattacagggaggcagaagctgacargagggcaggaagcactgtctccagggctgtcttgaaatcactgggctgactttgtaggtagtgagacgcccatcactggaggcatccgaaccaagcccag

SEQ ID NO: 73011 - DNA, 201 bp, Homo sapiens
tgtgagtccagggggcacccctgagcccgccaacatagccctatgaggtgcctggcacttcggggaggatttaggctcgcaaggcagggggcaggccctgygcacttgtgtccggaagagaggtggtgggaagagagatgctggaagctgggtgtgaggggtgtgaggggtgtgaggggcaggaggtggagggccaggcct

SEQ ID NO: 73012 - DNA, 201 bp, Homo sapiens
cctgaaatgcttggggaagaggggtggtacttactgtgtgtgtctccagatgactgagctagaccacccagaacacattacagggaggcagaagctgacaygagggcaggaagcactgtctccagggctgtcttgaaatcactgggctgactttgtaggtagtgagacgcccatcactggaggcatccgaaccaagcccag

SEQ ID NO: 73013 - DNA, 201 bp, Homo sapiens
cctttaggtcttgaacagttctggacaggtttattcctgatcatttcatcacggttttattgattttgaaactttatcccgtgacatgatcaaattggccytttctagagcacaggcacttcgtagctgttgaccatcatttagctccacgtctgcccgtcggttcctcgtgcgtggaatccagcaccacgtgggtgtctc

SEQ ID NO: 73014 - DNA, 201 bp, Homo sapiens
agcctggccaacatagtgaaaccctgtctctactaaaaatacaaaaattagccgggtgtggtggcaaaaagaaaaaaaaatatttacaacaacaggccatmagcccagcagtgggtctagtttgccaaccgctggaaaaagccagcaacattttgggaggccgactgccggctacaggacctcgccataccaacaagggct

SEQ ID NO: 73015 - DNA, 201 bp, Homo sapiens
aaattagccgggtgtggtggcaaaaagaaaaaaaaatatttacaacaacaggccatcagcccagcagtgggtctagtttgccaaccgctggaaaaagccarcaacattttgggaggccgactgccggctacaggacctcgccataccaacaagggctgagacccgcggctctgcagggctctaacaacagcgtttgacctg

SEQ ID NO: 73016 - DNA, 201 bp, Homo sapiens
gagactctgtctcaaaaaaaaaatatgaatctcccatggcaccacactgaagagtctgatcttgcttttacagaagaggaaaccgaggctcagagaggcaracagtcgggattcagaaccagtcccacttgactccaaagcccaggctcttttctccaatacttttcatgtcgcctcttttctctgaaatgtccatttcct

SEQ ID NO: 73017 - DNA, 201 bp, Homo sapiens
ggtgggagaatcgcttgggccaggaaattgaagctgcagtgatctgtgattgcaccactgcactccagcctgggtgacacagcaagactccgtctcaaaamaaaaaaaaaattatatttggagtacaactctgaatccatatgctaactattcataacattcttagcaccgaggctgtactgggcacccctccggagacga

SEQ ID NO: 73018 - DNA, 201 bp, Homo sapiens
gccaaaggaggtgaggtggggcaagggtgtttgcaaaggatagaaaagtctagaatggcagagtatggtgcttaagagtactatgtgacctaggccaagckacttcactctgggtgcctcagtttgctctttaggatggggatgataacaacagcagcacccatctacagagatgccagtgcttgtcaccacgagaagcac

SEQ ID NO: 73019 - DNA, 201 bp, Homo sapiens
gtatttttatgcatttgcctggttgttttatccctgctttccagaactagtgcacagaagggaagaccaccacagactgttcctttattccctgccctggrgccaactgggccaagtggacaagacctcacaagggagagtcaggccagcaatgctcatcccagctccaccctgaccccattcctcttggcatactcagtt

SEQ ID NO: 73020 - DNA, 201 bp, Homo sapiens
ggtgtgtgtgtaggggtgtgcgggcaagggtgtgtgtgcaggggtgtatgtgcaagggtgtgtgtgtctccatgcatgtgtgtgcaggggtgtgtgtgcakgtgtgtgtaggagtgtgtgtgcaggggtgtgtatgcaggggtgtgtgcgcgtagaggtatgtgtgcgtaggggtgtgtgtgcaggggtgtgtgtgcgtgg

SEQ ID NO: 73021 - DNA, 201 bp, Homo sapiens
tgtgtgtgtaggggtgtgcgggcaagggtgtgtgtgcaggggtgtatgtgcaagggtgtgtgtgtctccatgcatgtgtgtgcaggggtgtgtgtgcatgkgtgtgtaggagtgtgtgtgcaggggtgtgtatgcaggggtgtgtgcgcgtagaggtatgtgtgcgtaggggtgtgtgtgcaggggtgtgtgtgcgtgggg

SEQ ID NO: 73022 - DNA, 201 bp, Homo sapiens
atacaaaaaattagccaggtgtggtggtatatgcctgtaatcccagctactcaggaggctgaggcaggagaatcacttgaacccaggaggcggaggttgcrgtgagccaagatcgcaccactgtactctagcctaggcaacagagcaagactccatttcaaaaaaaaaaaaaatgtgttttttaataaagtaagtagagtc

SEQ ID NO: 73023 - DNA, 201 bp, Homo sapiens
tgaggcaggagaatcacttgaacccaggaggcggaggttgcagtgagccaagatcgcaccactgtactctagcctaggcaacagagcaagactccatttcaaaaaaaaaaaaaatgtgttttttaataaagtaagtagagtccgaggtggtggtgggctcttccacaggaccactgcctgagctttcacacctgaccttat

SEQ ID NO: 73024 - DNA, 201 bp, Homo sapiens
gctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctcc

SEQ ID NO: 73025 - DNA, 201 bp, Homo sapiens
ctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctccc

SEQ ID NO: 73026 - DNA, 201 bp, Homo sapiens
taaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtg

SEQ ID NO: 73027 - DNA, 201 bp, Homo sapiens
gcaccagtgaccctgctgctccagctcacagacagcagattccaggacctcccagccttcatacttgcatgagtcaattcccacataaatcccatcttacrcagctggatggagcctattggttctgtttctctgggaaaccctaatacggacccatagatacaaaatcttctatatgcttcttcctcggagaagatccct

SEQ ID NO: 73028 - DNA, 201 bp, Homo sapiens
cttctatatgcttcttcctcggagaagatccctacatcttttatcctctcagcgtggccttgacgcccattctaaagcaaggggagaggttctagtgaggmggaaatagcatggggaccaacaggatggcacgctaggccttcgatggcccttgcagaatgtccagcacgactgccaagtgctcgtcaggtcttttctgga

SEQ ID NO: 73029 - DNA, 201 bp, Homo sapiens
gaattatcaaagaaaccattttctctcccggatgaaacccaacctccacttactcctggggaggatccaatggcagttgcaggtggactcagctttgttcwttcactgggaaaggactgtgacgttccacgccttgtctaaactctccagaaaagtggggtgccatgagtgccaatgtccacaccctcaaatcacacagtt

SEQ ID NO: 73030 - DNA, 201 bp, Homo sapiens
gtggccactgcatgcatcccaggggccagccctggaggactccacactgcgtagacgcaaacgcggtaactgcaggccggagccgcagacgtcttctgagmgtcatttggttcatttggctctgggtggaattacatgccagtcatttcagaggaattatcaaagaaaccattttctctcccggatgaaacccaacctcca

SEQ ID NO: 73031 - DNA, 201 bp, Homo sapiens
ccgaggcaggtggatcacctgagctcaagagtttgagaccaggccaacatggtgaaaccccatctctactaaaaatacaaaaatgacccgggcgtggtggygcacacctacagtcccagctactcaggaggctaaggcaggagaatcgcttgaaccagggaagtgaaggttgcagtgagccgaaatcgcaccactgaactc

SEQ ID NO: 73032 - DNA, 201 bp, Homo sapiens
gcctctaaaaataccctccatgacacgctgtgtgctgccagaggcttggttttcgccctcttctccccaactcttagccacgtcccagtggtggcgggggracgggggtcccaagccactgcactgggttttggtttcactatgttgcccaggctggagtgcagtggtgcgatctcagcttactgcaacctccaccttccg

SEQ ID NO: 73033 - DNA, 201 bp, Homo sapiens
tgagttctagcctctaaaaataccctccatgacacgctgtgtgctgccagaggcttggttttcgccctcttctccccaactcttagccacgtcccagtggyggcggggggacgggggtcccaagccactgcactgggttttggtttcactatgttgcccaggctggagtgcagtggtgcgatctcagcttactgcaacctc

SEQ ID NO: 73034 - DNA, 201 bp, Homo sapiens
gtggcaatgaagaccagtggccactgcatgcatcccaggggccagccctggaggactccacactgcgtagacgcaaacgcggtaactgcaggccggagccrcagacgtcttctgagcgtcatttggttcatttggctctgggtggaattacatgccagtcatttcagaggaattatcaaagaaaccattttctctcccgga

SEQ ID NO: 73035 - DNA, 201 bp, Homo sapiens
gtctccagatgactgagctagaccacccagaacacattacagggaggcagaagctgacaggagggcaggaagcactgtctccagggctgtcttgaaatcaytgggctgactttgtaggtagtgagacgcccatcactggaggcatccgaaccaagcccagataaaacaaacatcagaaacatttttaactccgtttctctg

SEQ ID NO: 73036 - DNA, 201 bp, Homo sapiens
gtaactaatctcgttgggcttcaggatcacagtaaagacagcttagaaacatggaagctctccattcgggcagcacctccttcttttagcaggatggggcygacctcgccagctggagcagcagaagtggccacaaacgccaccagggatggcagacggtgatccaggaaggggctgtgctcacaaggaccccagacctgc

SEQ ID NO: 73037 - DNA, 201 bp, Homo sapiens
cactagaagcttccagcatcctccacaaatttgacaactgagaaatgtggctgggaaatcatgatttgggtccgaagaagtgaaagcaacaatcctcaggktgttgtttcttgagagaagaaggtaaacagcaggaattcggctgaggtgtccaaatctcggggaggatgaattctcaggagagctgaacctgagacaaag

SEQ ID NO: 73038 - DNA, 201 bp, Homo sapiens
aatcactggaactcaccgtggaggtggcattgagctgagattgtgccactgcactccagcctgggtgacacagcgagactccgtctcaaaaaaaaaaaaattttgatagtacataatttgtaaacctagtcaaactatcaatcaagactcaagaaagttatttcctgtgtcttctcaagaagctactgaaagatatgcatg

SEQ ID NO: 73039 - DNA, 201 bp, Homo sapiens
caaattccagttcaactagagagattcagcttcctggtgttcccagggggatctagctctgaaaagagcccctttcttctgtcaggacatcctcagcaaaraaggctgcaggtctgagctgagcagcctggagagtggggattccaactccccccgagagtgtctacctgcctggcttcctccctgaggaaagtcactgtc

SEQ ID NO: 73040 - DNA, 201 bp, Homo sapiens
tagagggccgtatgcaacaagattccctcaacttggtgaggaactgctttactccagcctcagctagtccatttgcctcccaaatgctggctagaagtagrgcagacttgggtaaggctccaagacgtatcctgctgtgtgaaaagaagcagagatgctgacagtaagaggcatctcttcagggctaagaagattacagct

SEQ ID NO: 73041 - DNA, 201 bp, Homo sapiens
tctgtctctctcagcagagccatgtgggaggcatttgggtccaccccaagagatactaaaactccttgtcttgggtgtttgtttgacattatttcaggcawctgtaggacaaagatgatgatccgtgcttttgttactttttaggaaagccatagaatattgtcttcccaaacaattttggcacttgtcatcctaaaatcc

SEQ ID NO: 73042 - DNA, 201 bp, Homo sapiens
gtctcaagaagtgaaatgtaacgatgaggatgacagttaacgtttattgggcccttactacatgccaggcaatgtttcaagagttttccaggtattaactratttaattctcaaaacagctctatcttgtaggtactatcattatctttatttaccacatgaagaaactgaggcacagagaagttaaataacttccacaag

SEQ ID NO: 73043 - DNA, 201 bp, Homo sapiens
tcagacccaccttggccaggcctgtgtcctcatgtctcaaaaaggggctttgtttcaatgaccacaggtttcatgcaaattattcacaccttgccacagtyagtgtcttcattgaccttgcctgcctagagacctgagtactgccttcttggactctgaagttggatgttgccatgctggaaacatcgaatagaaataggc

SEQ ID NO: 73044 - DNA, 201 bp, Homo sapiens
cgcctggctaattttttgtatttttagtagagacagggtttcactgtattagccaggatggtctcggtctcctgatctcatgatccacctgcctcggcctrccaaagtgctgggattacaggtgtgagccaacatgcccagcctcctctgtccatttttaattgagtgatttgtctcattattattgacttgtaagaactc

SEQ ID NO: 73045 - DNA, 201 bp, Homo sapiens
caaattccagttcaactagagagattcagcttcctggtgttcccagggggatctagctctgaaaagagcccctttcttctgtcaggacatcctcagcaaayaaggctgcaggtctgagctgagcagcctggagagtggggattccaactccccccgagagtgtctacctgcctggcttcctccctgaggaaagtcactgtc

SEQ ID NO: 73046 - DNA, 201 bp, Homo sapiens
ttcctagggcagatataaccatgctccactgtttctattcaaagtggcctccagaaagtttaagatatctcttgaaaagaaatcctttgactggagaaatrtgtatacacaaatatcttatgtcccggctacaataccatttaaaatccctcaaaggagagtgtttaacctaaaatccctcaaaggagagtgtttcacccc

SEQ ID NO: 73047 - DNA, 201 bp, Homo sapiens
tatgcatgccaggatgcctaatgttaagaagcagaatgagaagtgtgagtttaagtctacactttgatagagcttaggagagttcctagggcagatataarcatgctccactgtttctattcaaagtggcctccagaaagtttaagatatctcttgaaaagaaatcctttgactggagaaatctgtatacacaaatatctt

SEQ ID NO: 73048 - DNA, 201 bp, Homo sapiens
acgtcgcggggagcagccagtgcgcgcgcggggggcggggccggcacagagtccacgccccgcgcggctccctcgcgtcccgcgtcccgcgtcccgcgtcrcctgctcacccggtggcaaagccggcgaggaggcggcggcgctggtggggactgacccggcagtccgagaatccaccgcggccttttcacccaaccgccc

SEQ ID NO: 73049 - DNA, 201 bp, Homo sapiens
ttcttgcatggtctgcctagaccctgcatattcactctgtacttcagcctcatgggccttcttccagttccttccagtcacctgttgccaaatggcctgcrtttgactgtcctgttccctctgtgtgcagtgccccctcctaccctcttcaggaaactcctatgcttcttccagacctcagctccattatcatttctttag

SEQ ID NO: 73050 - DNA, 201 bp, Homo sapiens
ggaaggtgtaagagaattaagtttttatccattataatagaaaatcagggctgggtgcggtggcttacacctgtaatcccagcactttgggaggccaaggrgggcggattgcttgagcccaggagttcaagaccagactgggcaacatggtgaaattctgcctctacaaaaaatacaaaaattagccaggcatggtagtgc

SEQ ID NO: 73051 - DNA, 201 bp, Homo sapiens
tgaggatgtcctgacagaagaaaggggctcttttcagagctagatccccctgggaacaccaggaagctgaatctctctagttgaactggaatttgcccatytcaagtgttgctgaaaaataaatggtgcccggctggaactgggaatctttttgtgaattcagagccctttggtgtagtgggatttgtgttctgcagttgg

SEQ ID NO: 73052 - DNA, 201 bp, Homo sapiens
tgttagtttgagtctctaaaggactatatggaagaggctgtcttgctgacttttccactaatactgttacttaagaaaaaataaactattttgtttgagcrgttatatatttgcatctagctgtaaaagcagttgtactactcaaactaaaattaaaaggctgaggagttacaggtatcagaacctctacagttgaaggat

SEQ ID NO: 73053 - DNA, 201 bp, Homo sapiens
ttgtgactctaggcttacaacctattctcctagcaaccctcttttgggtcttcagctaacagagaggcctttaagaatgagaaacaggatgagtgctgagscttggaggcctaaaaagtagaggagaagagcagaggataaaggggagactgccaagaaattttcctccccattccctccctacccatgcatattgccctt

SEQ ID NO: 73054 - DNA, 201 bp, Homo sapiens
ataattaaaaagtactcataatatagttcaggaatagaaaatttacagccaacaaacccatatgaacctcagagatgtttttctctggtcattttattatycctacatatactatatcttaagtaacaatatagctgcatatttacctctgctttcagccaaaatttcactaaaatgacagtaaaagaataagtcctaaac

SEQ ID NO: 73055 - DNA, 201 bp, Homo sapiens
tcccttcaatggcccaaaaagtggaggtatgaaggggaaagacactgaccaagaagcaggggacttaattagaccttatatgcatgccaggatgcctaatyttaagaagcagaatgagaagtgtgagtttaagtctacactttgatagagcttaggagagttcctagggcagatataaccatgctccactgtttctattca

SEQ ID NO: 73056 - DNA, 201 bp, Homo sapiens
tttcagctatatcctcagctcttgacatagtactgaaagaaatctctaccccttctttcttcaaaaagcctttttttcctttttttttttttttttttttagagatggagtctcactctgtctcccaggctggagtgcagtggcgcaatcttggcttgctgaaatctccacctcctgggttcaagcaattctctcacctca

SEQ ID NO: 73057 - DNA, 201 bp, Homo sapiens
caattctagacccatagatccaactgcctttttcaacttctctacttagatattccacaggcacttcaaatgtaaattatcccactgatattttctatcayacttgcgcattctcccttattccctatctcggtgggtgaaattctgcctcctcttattttcttcttcatttacgttactgctaagcccaatctcctaaca

SEQ ID NO: 73058 - DNA, 201 bp, Homo sapiens
tgagcctagaaggtggaggtggtagtgagccaagatcacaccactgcactccagcctgggcaacaaagcgagaccctgcctcaaaaaaaaaaaaaaaaaatgtaagactagatagatagtgatgaagacagttaattaagaaatagcagtatcaccatttacttggagatatggagatccctaacacaagcaacagcttta

SEQ ID NO: 73059 - DNA, 201 bp, Homo sapiens
tctccatagaaaatatttattattattaccttatatacatttacttaattttactttctgcctccttcctcccacaagaatgaaagttccgtcaaggcagyaactcagttttggttcactattatatctccaaagcttaaattattgcatgacatgtgtagtaggtactcaataaatatttgtatattaaattaactgatc

SEQ ID NO: 73060 - DNA, 201 bp, Homo sapiens
gcagagacttcttagtgacaggccacatccctctttcccattgtcccccaggtgccataaaaataatgaaggagcctcccataactgagctctatctttgkttcttatttatacttccttcaagtgaggacttcactggtattgtcagagcaggtaccataaaccaatttgcagtaggccaccctgaatgaatgaaaatgc

SEQ ID NO: 73061 - DNA, 201 bp, Homo sapiens
gaaaattgagtcaacactggtctatcccacatgtatttataaagtaaaagaataataatgtacttctaaggtcacttctaagattgtactaaggctgcaaraacagttccaagagagtttaagcatgctgcctcaccccagcgcttgcggctctcctagccctacctcggtctgccttggtttctgtaacctggctgttct

SEQ ID NO: 73062 - DNA, 201 bp, Homo sapiens
aaagcgattgtgaaattcaagaaaacaatcaaactacaagaaaactccagataaaactacaaagttaaacataaacttggcccaggaccactacagtggcrgagggatgacaaatacagttctttatattggtaacccttagccatccatcccattctatagaaagaggacagtaccatctttgaccccaggccccctgtc

SEQ ID NO: 73063 - DNA, 201 bp, Homo sapiens
ctccaacagtactcgggaagctctgtggataactgccatgtccacctgagccaggcactcaccttaagtatttcctgatggttctcagatgcatagagccygccatctcgaactatgtcttcaatgagttcctggtagtcctctgttggaataaagaacatgttttgcattcttatgatttagttgcttccaaactcactc

SEQ ID NO: 73064 - DNA, 201 bp, Homo sapiens
actctaatgagtcactgatacgggaggcagcaatacccgactgtgctgacatgcagaaggaagacagctctgtcccaccaaccctatagcagaacatttgrattgagtggcacgtgggctgagtcatttgtaaggtctcaaaaacctggacactttggaacgtagcaatcggatgaacgatcttggaaacatctctcggga

SEQ ID NO: 73065 - DNA, 201 bp, Homo sapiens; identical to SEQ ID NO: 73045

SEQ ID NO: 73066 - DNA, 201 bp, Homo sapiens
ttccatatacaaaccactctccctttattcattcagattcaacaccatccacactcacttccttgctcaaaatttctttcccattccaatccctttgcacrggctgtcccctctgcctgaaatgttcttcccctaacatttctaatagttaggtccctcttatcttccaggtctctgttcaaatgtcatttcctcagagat

SEQ ID NO: 73067 - DNA, 201 bp, Homo sapiens
aaatcttagagaaggcacctatcagtgtgataaatgtagataatgcattttcagagaagtacattaggaatactgggcccggggggtactgggtgagtgargctgtttgagtcatcccagttcctcatggggagccttagtgatggtttatcaagcctctttttttaaattgttttgttttttgtttttgagacagcatct

SEQ ID NO: 73068 - DNA, 201 bp, Homo sapiens
agtattcaaataatgtttgctattacgaggatgcaatcacgactctgcaaatcttcagtttgtgccagatcttggtgttatactggtatttcacgcttctrttctaagcctctgaaattctccagcccatgatttgtggtgatatggatagctaatctatagggcacaccacacagacctgctctaatagacagagattct

SEQ ID NO: 73069 - DNA, 201 bp, Homo sapiens
tgggccacctcttcatctaacatgaagaaaattaaaacagaagtcatctgacttgcccaagatcccacagtgagtcagtgaaaaagccaggaccagaactkaggtccttccctgcctcaggattctacctaataaaagccacaatcatcagaagttaatatttactgaacaattgctatgtgccaggcactgcctcacgtc

SEQ ID NO: 73070 - DNA, 201 bp, Homo sapiens
tacgttactgctaagcccaatctcctaacattactttcatggtcctcttcccccacagtggttctcttgctagttgtaacaaagaaaaatcctcaatttaycattcaagaccttccactaccattcatcctccttcccaatctcatctttttaattactactccatgaaggctttctgctttcagcaaattaccacttgtc

SEQ ID NO: 73071 - DNA, 201 bp, Homo sapiens
caaattccagttcaactagagagattcagcttcctggtgttcccagggggatctagctctgaaaagagcccctttcttctgtcaggacatcctcagcaaasaaggctgcaggtctgagctgagcagcctggagagtggggattccaactccccccgagagtgtctacctgcctggcttcctccctgaggaaagtcactgtc

SEQ ID NO: 73072 - DNA, 201 bp, Homo sapiens; identical to SEQ ID NO: 73039

SEQ ID NO: 73073 - DNA, 201 bp, Homo sapiens
atgtgacattcgaattttcatcttatggttagactcagaaatataggccaagctccagtataacaaagtccaagtgcttgttttaatgctatttttttttaaatgatgatgttcaaacttttgaagagaaatctgaaaatgaatatttagggcccatccaaataaagaagtttgattaggactttttaagaatcaatgtta

SEQ ID NO: 73074 - DNA, 201 bp, Homo sapiens
gagggatgtggcctgtcactaagaagtctctgctttctatccctcaagcaacctcataatattctgcagaggcgcctcatggaaaccaacctgtctaagckccgaagcggtccccgtgtcccttgggcctctaagacgaacaaactcaatcaggctaagtctgaggggctaaagaagtctgaggaggatgacatgattttg

SEQ ID NO: 73075 - DNA, 201 bp, Homo sapiens
tgtctacactccgttagcacattgcactttgagttctgtactctccctggcacatgctgcacagtggtcagacccaccttggccaggcctgtgtcctcatytctcaaaaaggggctttgtttcaatgaccacaggtttcatgcaaattattcacaccttgccacagtgagtgtcttcattgaccttgcctgcctagagacc

SEQ ID NO: 73076 - DNA, 201 bp, Homo sapiens
tttggtttcatttcccgggatgagaacaggctttgacctcaactcagacagcaaaagaggagaaataatggaaagaaaacaaacaccagtatctgaaggargtgtgtctggtggaagtggggaagtgaggagtctaggcttagctttgaatctggttccaccccttgcttgctatgggaccttggccaagttactgaagct

SEQ ID NO: 73077 - DNA, 201 bp, Homo sapiens; identical to SEQ ID NO: 73045

SEQ ID NO: 73078 - DNA, 201 bp, Homo sapiens
atgggtggatagggtgaaaagacaggaattcacacttgctgagcaagcctctcagcagacacactttgaaacctgagagaacacacaagaatcatcgatgrtggcatcccctggtcctcaaaacactggtttctcctgccctatcttgtcatccatttcccttcccttcaatggcccaaaaagtggaggtatgaaggggaa

SEQ ID NO: 73079 - DNA, 201 bp, Homo sapiens
tgtggcctcctttccactacagactccttgaggaggagtaagaccccagaaggacaggtgagtctcacctaggctgaccaaagtccagctcagccagcccmtgatctatccaagacatccgcccacagcagtgagaagctgatgccactcaaagccattctcagtctacatccacgatgctgggaaagaaaaaccaagttc

SEQ ID NO: 73080 - DNA, 201 bp, Homo sapiens
ctgtcctgtggactgagtcacccatgggtggatagggtgaaaagacaggaattcacacttgctgagcaagcctctcagcagacacactttgaaacctgagkgaacacacaagaatcatcgatgctggcatcccctggtcctcaaaacactggtttctcctgccctatcttgtcatccatttcccttcccttcaatggccca

SEQ ID NO: 73081 - DNA, 201 bp, Homo sapiens
acatttccacagctttctttgtcctccatgacacagacatttttgacattcaaaatgttaaaattcaaaactgtcagtgtcattaaaaagggttaactggmtaacacaaaaaccagttaaccctttttagttactggtttctgtgtgtgatataattcacataccataaaattcacccaattcatacaattgtacttaatg

SEQ ID NO: 73082 - DNA, 201 bp, Homo sapiens
tgtcccctctgcctgaaatgttcttcccctaacatttctaatagttaggtccctcttatcttccaggtctctgttcaaatgtcatttcctcagagataccmtccttgaccatacaacttaaagtaggtaggtcacctttttagttactaacaaatctcactatttctttcatagtaattatcaatatgaaattattttgtg

SEQ ID NO: 73083 - DNA, 201 bp, Homo sapiens
cttattattgaattgtgagagttctttttttttaatactttaagttctggggtacatgtacagaacatgcaggtttgttacataggtatacacttgccatygtggtttgctgcacccatcaacccatcatctacattaggtatttctcccaatgctatccctccctcagccccctaccctgcaacaggccccagtgtgtga

SEQ ID NO: 73084 - DNA, 201 bp, Homo sapiens
tatactgtgtataatttttgtatattatattatactgtgtataatataatgtacctgtgtatcattagagctgttaaattaaaaaaaaaaaaaaaaaaaatggaaatggatgcagaagctctgccctcctggggccagaaatggcaatttcagtgaactagggccgacaaccacatccaaaattaaatatttcaaaagctt

SEQ ID NO: 73085 - DNA, 201 bp, Homo sapiens
gagccaagatcacaccactgcactccagcctgggcaacaaagcgagaccctgcctcaaaaaaaaaaaaaaaaaaagtaagactagatagatagtgatgaayacagttaattaagaaatagcagtatcaccatttacttggagatatggagatccctaacacaagcaacagctttaaatttttaaaagttttaaattattta

SEQ ID NO: 73086 - DNA, 17 bp, Homo sapiens
ctgcagcctctcctacg

SEQ ID NO: 73087 - DNA, 18 bp, Homo sapiens
cctgcagcctctcctaca

SEQ ID NO: 73088 - DNA, 19 bp, Homo sapiens
gattccccatcggtcataa

SEQ ID NO: 73089 - DNA, 22 bp, Homo sapiens
ggaagttgagattctttcagaa

SEQ ID NO: 73090 - DNA, 22 bp, Homo sapiens
ggaagttgagattctttcagag

SEQ ID NO: 73091 - DNA, 25 bp, Homo sapiens
agtgattggaaatccatatttactt

SEQ ID NO: 73092 - DNA, 16 bp, Homo sapiens
gccccacttttgcatg

SEQ ID NO: 73093 - DNA, 17 bp, Homo sapiens
agccccacttttgcatt

SEQ ID NO: 73094 - DNA, 20 bp, Homo sapiens
acccctgcacagtttagaac

SEQ ID NO: 73095 - DNA, 15 bp, Homo sapiens
ggtgctccacctggt

SEQ ID NO: 73096 - DNA, 14 bp, Homo sapiens
gtgctccacctggc

SEQ ID NO: 73097 - DNA, 23 bp, Homo sapiens
ggagttcgaacctaaagacgtat

SEQ ID NO: 73098 - DNA, 21 bp, Homo sapiens
agctgttcgtgttctatgatc

SEQ ID NO: 73099 - DNA, 21 bp, Homo sapiens
agctgttcgtgttctatgatg

SEQ ID NO: 73100 - DNA, 22 bp, Homo sapiens
gaagtcaacagtgaacatgtga

SEQ ID NO: 73101 - DNA, 17 bp, Homo sapiens
cccgttggttccgaaag

SEQ ID NO: 73102 - DNA, 17 bp, Homo sapiens
cccgttggttccgaaaa

SEQ ID NO: 73103 - DNA, 24 bp, Homo sapiens
tgaatagccattagaaaaaactgt

SEQ ID NO: 73104 - DNA, 21 bp, Homo sapiens
ttccagggtatatctcagagc

SEQ ID NO: 73105 - DNA, 22 bp, Homo sapiens
gttccagggtatatctcagaga

SEQ ID NO: 73106 - DNA, 22 bp, Homo sapiens
ttgaaagagtgtgagcaagatc

SEQ ID NO: 73107 - DNA, 24 bp, Homo sapiens
caaaatgtagaaggttcatatgag

SEQ ID NO: 73108 - DNA, 24 bp, Homo sapiens
caaaatgtagaaggttcatatgac

SEQ ID NO: 73109 - DNA, 23 bp, Homo sapiens
gagctgtgtgtttctttgttcta

SEQ ID NO: 73110 - DNA, 15 bp, Homo sapiens
cccagggctcctgac

SEQ ID NO: 73111 - DNA, 15 bp, Homo sapiens
cccagggctcctgat

SEQ ID NO: 73112 - DNA, 23 bp, Homo sapiens
aaaaagccctttggtattgtata

SEQ ID NO: 73113 - DNA, 20 bp, Homo sapiens
gttgaagggaagttcagcat

SEQ ID NO: 73114 - DNA, 19 bp, Homo sapiens
ttgaagggaagttcagcaa

SEQ ID NO: 73115 - DNA, 20 bp, Homo sapiens
tcacggaggacaggtagaat

SEQ ID NO: 73116 - DNA, 15 bp, Homo sapiens
gcgcacccaggtcag

SEQ ID NO: 73117 - DNA, 15 bp, Homo sapiens
gcgcacccaggtcaa

SEQ ID NO: 73118 - DNA, 19 bp, Homo sapiens
ccacgttctggtcgatctt

SEQ ID NO: 73119 - DNA, 16 bp, Homo sapiens
ctgctgctgctcctga

SEQ ID NO: 73120 - DNA, 15 bp, Homo sapiens
tgctgctgctcctgc

SEQ ID NO: 73121 - DNA, 20 bp, Homo sapiens
acttgagcttcctggagaag

SEQ ID NO: 73122 - DNA, 17 bp, Homo sapiens
ccacagcgaggcttttc

SEQ ID NO: 73123 - DNA, 17 bp, Homo sapiens
ccacagcgaggcttttt

SEQ ID NO: 73124 - DNA, 22 bp, Homo sapiens
gcactaatgtgatcgttgaaaa

SEQ ID NO: 73125 - DNA, 15 bp, Homo sapiens
agccccagaacctgc

SEQ ID NO: 73126 - DNA, 15 bp, Homo sapiens
agccccagaacctgg

SEQ ID NO: 73127 - DNA, 19 bp, Homo sapiens
gggctgggcttgtagaata

SEQ ID NO: 73128 - DNA, 22 bp, Homo sapiens
gaaaaggaggatgaagatgtct

SEQ ID NO: 73129 - DNA, 20 bp, Homo sapiens
aaaggaggatgaagatgtcg

SEQ ID NO: 73130 - DNA, 19 bp, Homo sapiens
caccatgctctgcaaagac

SEQ ID NO: 73131 - DNA, 22 bp, Homo sapiens
catccaacagctcttctatcat

SEQ ID NO: 73132 - DNA, 22 bp, Homo sapiens
catccaacagctcttctatcac

SEQ ID NO: 73133 - DNA, 18 bp, Homo sapiens
caaacatccgaggacaag

SEQ ID NO: 73134 - DNA, 19 bp, Homo sapiens
ctgccctctttttagcaga

SEQ ID NO: 73135 - DNA, 19 bp, Homo sapiens
ctgccctctttttagcagt

SEQ ID NO: 73136 - DNA, 22 bp, Homo sapiens
ccctttctcattcattcatttt

SEQ ID NO: 73137 - DNA, 17 bp, Homo sapiens
gacgtcttccagtacca

SEQ ID NO: 73138 - DNA, 16 bp, Homo sapiens
acgtcttccagtaccg

SEQ ID NO: 73139 - DNA, 17 bp, Homo sapiens
tcttcctcgctcagaat

SEQ ID NO: 73140 - DNA, 14 bp, Homo sapiens
agcattgccgtcct

SEQ ID NO: 73141 - DNA, 13 bp, Homo sapiens
gcattgccgtccc

SEQ ID NO: 73142 - DNA, 17 bp, Homo sapiens
ccatgggtcaaagaaca

SEQ ID NO: 73143 - DNA, 21 bp, Homo sapiens
ccagatccagttttctagcat

SEQ ID NO: 73144 - DNA, 21 bp, Homo sapiens
ccagatccagttttctagcac

SEQ ID NO: 73145 - DNA, 19 bp, Homo sapiens
cccttcctccagcattatc

SEQ ID NO: 73146 - DNA, 18 bp, Homo sapiens
ctgtgagtgggccttcat

SEQ ID NO: 73147 - DNA, 18 bp, Homo sapiens
ctgtgagtgggccttcac

SEQ ID NO: 73148 - DNA, 15 bp, Homo sapiens
ggagccccgcttcat

SEQ ID NO: 73149 - DNA, 18 bp, Homo sapiens
gaaggcccactcacagac

SEQ ID NO: 73150 - DNA, 18 bp, Homo sapiens
gaaggcccactcacagat

SEQ ID NO: 73151 - DNA, 15 bp, Homo sapiens
cggacccggagactg

SEQ ID NO: 73152 - DNA, 19 bp, Homo sapiens
tcacagactgaccgagtga

SEQ ID NO: 73153 - DNA, 18 bp, Homo sapiens
cacagactgaccgagtgg

SEQ ID NO: 73154 - DNA, 16 bp, Homo sapiens
cggacccggagactgt

SEQ ID NO: 73155 - DNA, 24 bp, Homo sapiens
gtctttagaagcctcttcagaata

SEQ ID NO: 73156 - DNA, 22 bp, Homo sapiens
ctttagaagcctcttcagaatg

SEQ ID NO: 73157 - DNA, 17 bp, Homo sapiens
cggctttggcctacaag

SEQ ID NO: 73158 - DNA, 21 bp, Homo sapiens
agtacctcttggtctctctcc

SEQ ID NO: 73159 - DNA, 21 bp, Homo sapiens
agtacctcttggtctctctcg

SEQ ID NO: 73160 - DNA, 23 bp, Homo sapiens
gcatgttgtgtttctgattgtac

SEQ ID NO: 73161 - DNA, 18 bp, Homo sapiens
acgaagcttccgaggaag

SEQ ID NO: 73162 - DNA, 17 bp, Homo sapiens
cgaagcttccgaggaat

SEQ ID NO: 73163 - DNA, 19 bp, Homo sapiens
gacaccggacgagagagac

SEQ ID NO: 73164 - DNA, 17 bp, Homo sapiens
atcccccacagatccag

SEQ ID NO: 73165 - DNA, 17 bp, Homo sapiens
atcccccacagatccac

SEQ ID NO: 73166 - DNA, 18 bp, Homo sapiens
ccagctggacccagtaag

SEQ ID NO: 73167 - DNA, 26 bp, Homo sapiens
ctctctttctagaaactgaagaaatt

SEQ ID NO: 73168 - DNA, 25 bp, Homo sapiens
tctctttctagaaactgaagaaatc

SEQ ID NO: 73169 - DNA, 18 bp, Homo sapiens
gggcagggctaggagtag

SEQ ID NO: 73170 - DNA, 23 bp, Homo sapiens
ggatatgagttggacatgaagac

SEQ ID NO: 73171 - DNA, 23 bp, Homo sapiens
ggatatgagttggacatgaagat

SEQ ID NO: 73172 - DNA, 19 bp, Homo sapiens
caggttttggtgggagaac

SEQ ID NO: 73173 - DNA, 14 bp, Homo sapiens
cgtgaccctgccgt

SEQ ID NO: 73174 - DNA, 14 bp, Homo sapiens
cgtgaccctgccgc

SEQ ID NO: 73175 - DNA, 16 bp, Homo sapiens
gggccagcatgtggac

SEQ ID NO: 73176 - DNA, 22 bp, Homo sapiens
aaagggaaggaggttacttact

SEQ ID NO: 73177 - DNA, 20 bp, Homo sapiens
agggaaggaggttacttacg

SEQ ID NO: 73178 - DNA, 20 bp, Homo sapiens
tcctctgtggagagggatac

SEQ ID NO: 73179 - DNA, 22 bp, Homo sapiens
ggttctgacatgactgtgacag

SEQ ID NO: 73180 - DNA, 21 bp, Homo sapiens
gttctgacatgactgtgacaa

SEQ ID NO: 73181 - DNA, 18 bp, Homo sapiens
ccccaacccaaggtttac

SEQ ID NO: 73182 - DNA, 16 bp, Homo sapiens
gggctggacattgcaa

SEQ ID NO: 73183 - DNA, 16 bp, Homo sapiens
gggctggacattgcac

SEQ ID NO: 73184 - DNA, 25 bp, Homo sapiens
ccagattagccttaactctgttaac

SEQ ID NO: 73185 - DNA, 18 bp, Homo sapiens
gcgtgatgatgaaatcgg

SEQ ID NO: 73186 - DNA, 18 bp, Homo sapiens
gcgtgatgatgaaatcga

SEQ ID NO: 73187 - DNA, 20 bp, Homo sapiens
agcctctcctgactgtcatc

SEQ ID NO: 73188 - DNA, 18 bp, Homo sapiens
acgagagcatcatctgca

SEQ ID NO: 73189 - DNA, 17 bp, Homo sapiens
cgagagcatcatctgcg

SEQ ID NO: 73190 - DNA, 21 bp, Homo sapiens
ccagacattgcagttgaagtc

SEQ ID NO: 73191 - DNA, 15 bp, Homo sapiens
gcagcagtcgccctt

SEQ ID NO: 73192 - DNA, 15 bp, Homo sapiens
gcagcagtcgccctg

SEQ ID NO: 73193 - DNA, 24 bp, Homo sapiens
cattttgctgatgtttgtttctag

SEQ ID NO: 73194 - DNA, 17 bp, Homo sapiens
cagaacgctgggaaaca

SEQ ID NO: 73195 - DNA, 16 bp, Homo sapiens
agaacgctgggaaacg

SEQ ID NO: 73196 - DNA, 17 bp, Homo sapiens
ctccccacctgttgctc

SEQ ID NO: 73197 - DNA, 17 bp, Homo sapiens
gacactgccctcatcgt

SEQ ID NO: 73198 - DNA, 15 bp, Homo sapiens
cactgccctcatcgc

SEQ ID NO: 73199 - DNA, 20 bp, Homo sapiens
cctgtccttgaggtctgatc

SEQ ID NO: 73200 - DNA, 13 bp, Homo sapiens
cccagtgggtcct

SEQ ID NO: 73201 - DNA, 13 bp, Homo sapiens
cccagtgggtccc

SEQ ID NO: 73202 - DNA, 16 bp, Homo sapiens
tgccatcgttgttttg

SEQ ID NO: 73203 - DNA, 16 bp, Homo sapiens
tccacgtggaccaggt

SEQ ID NO: 73204 - DNA, 15 bp, Homo sapiens
ccacgtggaccaggc

SEQ ID NO: 73205 - DNA, 19 bp, Homo sapiens
gcccaggtatttcatcagc

SEQ ID NO: 73206 - DNA, 24 bp, Homo sapiens
tcttatcagtcttggacaagaact

SEQ ID NO: 73207 - DNA, 22 bp, Homo sapiens
ttatcagtcttggacaagaacc

SEQ ID NO: 73208 - DNA, 24 bp, Homo sapiens
ctcttgctttctgtcttcatagac

SEQ ID NO: 73209 - DNA, 23 bp, Homo sapiens
cagttttccatgggttctactac

SEQ ID NO: 73210 - DNA, 23 bp, Homo sapiens
cagttttccatgggttctactat

SEQ ID NO: 73211 - DNA, 25 bp, Homo sapiens
ttatgaaatggtacagacaagtgat

SEQ ID NO: 73212 - DNA, 18 bp, Homo sapiens
ctccatcattgcagacca

SEQ ID NO: 73213 - DNA, 17 bp, Homo sapiens
tccatcattgcagaccg

SEQ ID NO: 73214 - DNA, 20 bp, Homo sapiens
ccaattcccctgatgttaaa

SEQ ID NO: 73215 - DNA, 13 bp, Homo sapiens
cgcccctcccgct

SEQ ID NO: 73216 - DNA, 13 bp, Homo sapiens
cgcccctcccgca

SEQ ID NO: 73217 - DNA, 18 bp, Homo sapiens
tgatccctcccttggata

SEQ ID NO: 73218 - DNA, 22 bp, Homo sapiens
actcaccagttgtgaagacttc

SEQ ID NO: 73219 - DNA, 23 bp, Homo sapiens
tactcaccagttgtgaagacttt

SEQ ID NO: 73220 - DNA, 21 bp, Homo sapiens
tcagggagcctagatatctca

SEQ ID NO: 73221 - DNA, 17 bp, Homo sapiens
tggtgtcaggtcccctt

SEQ ID NO: 73222 - DNA, 17 bp, Homo sapiens
tggtgtcaggtcccctc

SEQ ID NO: 73223 - DNA, 18 bp, Homo sapiens
gcagccaccttgacactc

SEQ ID NO: 73224 - DNA, 15 bp, Homo sapiens
tggggttggggttct

SEQ ID NO: 73225 - DNA, 14 bp, Homo sapiens
ggggttggggttcc

SEQ ID NO: 73226 - DNA, 19 bp, Homo sapiens
tgtccctgtcctccttcag

SEQ ID NO: 73227 - DNA, 15 bp, Homo sapiens
actggccccttgcat

SEQ ID NO: 73228 - DNA, 15 bp, Homo sapiens
actggccccttgcag

SEQ ID NO: 73229 - DNA, 19 bp, Homo sapiens
aggagggaaccaaacctta

SEQ ID NO: 73230 - DNA, 20 bp, Homo sapiens
agttgtcagtgcctctgttg

SEQ ID NO: 73231 - DNA, 20 bp, Homo sapiens
agttgtcagtgcctctgttc

SEQ ID NO: 73232 - DNA, 23 bp, Homo sapiens
acaacccttgaatgagagaatac

SEQ ID NO: 73233 - DNA, 15 bp, Homo sapiens
tctggcttccgggaa

SEQ ID NO: 73234 - DNA, 15 bp, Homo sapiens
tctggcttccgggag

SEQ ID NO: 73235 - DNA, 22 bp, Homo sapiens
cgtagctgttgaccatcattta

SEQ ID NO: 73236 - DNA, 20 bp, Homo sapiens
cacaggctatgacctcaaca

SEQ ID NO: 73237 - DNA, 19 bp, Homo sapiens
acaggctatgacctcaacg

SEQ ID NO: 73238 - DNA, 23 bp, Homo sapiens
aaccatggagctactcttctgta

SEQ ID NO: 73239 - DNA, 21 bp, Homo sapiens
aggtggagattctcaacagat

SEQ ID NO: 73240 - DNA, 21 bp, Homo sapiens
aggtggagattctcaacagac

SEQ ID NO: 73241 - DNA, 22 bp, Homo sapiens
aggctgttctcatgacatacat

SEQ ID NO: 73242 - DNA, 17 bp, Homo sapiens
gggatggaagagcttca

SEQ ID NO: 73243 - DNA, 17 bp, Homo sapiens
gggatggaagagcttcg

SEQ ID NO: 73244 - DNA, 18 bp, Homo sapiens
ctgcagccttcctctgac

SEQ ID NO: 73245 - DNA, 20 bp, Homo sapiens
actatgagagcatcatgtgt

SEQ ID NO: 73246 - DNA, 19 bp, Homo sapiens
ctatgagagcatcatgtgc

SEQ ID NO: 73247 - DNA, 23 bp, Homo sapiens
actgagtcctgaagaaaaatcag

SEQ ID NO: 73248 - DNA, 21 bp, Homo sapiens
tgtccagatccacatagaaca

SEQ ID NO: 73249 - DNA, 22 bp, Homo sapiens
ttgtccagatccacatagaact

SEQ ID NO: 73250 - DNA, 18 bp, Homo sapiens
ctttatgcagcggaccat

SEQ ID NO: 73251 - DNA, 17 bp, Homo sapiens
tcccccgagaagaagac

SEQ ID NO: 73252 - DNA, 17 bp, Homo sapiens
tcccccgagaagaagat

SEQ ID NO: 73253 - DNA, 20 bp, Homo sapiens
tgctgtcaaccctctctctt

SEQ ID NO: 73254 - DNA, 21 bp, Homo sapiens
acctggtggcacatctaatat

SEQ ID NO: 73255 - DNA, 20 bp, Homo sapiens
cctggtggcacatctaatag

SEQ ID NO: 73256 - DNA, 22 bp, Homo sapiens
tgtggaatgtggaaacaatact

SEQ ID NO: 73257 - DNA, 18 bp, Homo sapiens
gcctgcattactcaaggg

SEQ ID NO: 73258 - DNA, 19 bp, Homo sapiens
tgcctgcattactcaaggt

SEQ ID NO: 73259 - DNA, 20 bp, Homo sapiens
cagagagggtcaggagttga

SEQ ID NO: 73260 - DNA, 17 bp, Homo sapiens
ctgccatgatgttcacg

SEQ ID NO: 73261 - DNA, 18 bp, Homo sapiens
cctgccatgatgttcaca

SEQ ID NO: 73262 - DNA, 21 bp, Homo sapiens
gatggctgcatagcagtagat

SEQ ID NO: 73263 - DNA, 16 bp, Homo sapiens
ctactgccccgacctg

SEQ ID NO: 73264 - DNA, 16 bp, Homo sapiens
ctactgccccgacctt

SEQ ID NO: 73265 - DNA, 22 bp, Homo sapiens
gtcatggcgctactagatgtat

SEQ ID NO: 73266 - DNA, 17 bp, Homo sapiens
tgcctggtgagggagat

SEQ ID NO: 73267 - DNA, 17 bp, Homo sapiens
tgcctggtgagggagac

SEQ ID NO: 73268 - DNA, 25 bp, Homo sapiens
cacacacaagaaagtaaaacatgaa

SEQ ID NO: 73269 - DNA, 16 bp, Homo sapiens
caccttccagccggta

SEQ ID NO: 73270 - DNA, 15 bp, Homo sapiens
accttccagccggtg

SEQ ID NO: 73271 - DNA, 20 bp, Homo sapiens
tgaggtagcccagtgacttc

SEQ ID NO: 73272 - DNA, 23 bp, Homo sapiens
tcaaaattcatggtcactttaat

SEQ ID NO: 73273 - DNA, 23 bp, Homo sapiens
tcaaaattcatggtcactttaac

SEQ ID NO: 73274 - DNA, 20 bp, Homo sapiens
cctcttccatgcactcactt

SEQ ID NO: 73275 - DNA, 20 bp, Homo sapiens
tggatgttggaacaattgac

SEQ ID NO: 73276 - DNA, 20 bp, Homo sapiens
tggatgttggaacaattgag

SEQ ID NO: 73277 - DNA, 21 bp, Homo sapiens
ccagccagcaaagatacatac

SEQ ID NO: 73278 - DNA, 14 bp, Homo sapiens
gagccctgcgcact

SEQ ID NO: 73279 - DNA, 13 bp, Homo sapiens
agccctgcgcacc

SEQ ID NO: 73280 - DNA, 20 bp, Homo sapiens
ggcacgattgctcttagtgt

SEQ ID NO: 73281 - DNA, 17 bp, Homo sapiens
ggtcgtcctgcacttcg

SEQ ID NO: 73282 - DNA, 18 bp, Homo sapiens
tggtcgtcctgcacttct

SEQ ID NO: 73283 - DNA, 19 bp, Homo sapiens
ccagctcccctctcttttc

SEQ ID NO: 73284 - DNA, 16 bp, Homo sapiens
tcacctgcttttgcca

SEQ ID NO: 73285 - DNA, 15 bp, Homo sapiens
cacctgcttttgccg

SEQ ID NO: 73286 - DNA, 16 bp, Homo sapiens
ggcccaacccagtgac

SEQ ID NO: 73287 - DNA, 22 bp, Homo sapiens
caagaggatttttatggaatgg

SEQ ID NO: 73288 - DNA, 23 bp, Homo sapiens
acaagaggatttttatggaatga

SEQ ID NO: 73289 - DNA, 21 bp, Homo sapiens
ggtggtgaggctttgagtata

SEQ ID NO: 73290 - DNA, 18 bp, Homo sapiens
cccacattctctctcctt

SEQ ID NO: 73291 - DNA, 18 bp, Homo sapiens
cccacattctctctcctc

SEQ ID NO: 73292 - DNA, 17 bp, Homo sapiens
tgaggagcgtgggtgac

SEQ ID NO: 73293 - DNA, 17 bp, Homo sapiens
ctgaggcctatgtcctc

SEQ ID NO: 73294 - DNA, 17 bp, Homo sapiens
ctgaggcctatgtcctt

SEQ ID NO: 73295 - DNA, 21 bp, Homo sapiens
agctctcctttgttgctactg

SEQ ID NO: 73296 - DNA, 17 bp, Homo sapiens
cggttgaagtccttgat

SEQ ID NO: 73297 - DNA, 17 bp, Homo sapiens
cggttgaagtccttgac

SEQ ID NO: 73298 - DNA, 20 bp, Homo sapiens
ggttgtgcagagacatctga

SEQ ID NO: 73299 - DNA, 21 bp, Homo sapiens
tctgcttaaatatggcttgtg

SEQ ID NO: 73300 - DNA, 22 bp, Homo sapiens
ttctgcttaaatatggcttgtc

SEQ ID NO: 73301 - DNA, 25 bp, Homo sapiens
gcagttgttaaggacagaaatactt

SEQ ID NO: 73302 - DNA, 20 bp, Homo sapiens
aacaaacgtaccattgaggc

SEQ ID NO: 73303 - DNA, 22 bp, Homo sapiens
gaaacaaacgtaccattgaggt

SEQ ID NO: 73304 - DNA, 21 bp, Homo sapiens
tccacgctgatctgaagatac

SEQ ID NO: 73305 - DNA, 18 bp, Homo sapiens
cgcacaccaggttctcat

SEQ ID NO: 73306 - DNA, 18 bp, Homo sapiens
cgcacaccaggttctcac

SEQ ID NO: 73307 - DNA, 21 bp, Homo sapiens
gcaactacctgggccactata

SEQ ID NO: 73308 - DNA, 15 bp, Homo sapiens
cccccactctccagc

SEQ ID NO: 73309 - DNA, 15 bp, Homo sapiens
cccccactctccagg

SEQ ID NO: 73310 - DNA, 19 bp, Homo sapiens
ggcaaaagcactgtgaaga

SEQ ID NO: 73311 - DNA, 14 bp, Homo sapiens
ccccaaccaccacg

SEQ ID NO: 73312 - DNA, 15 bp, Homo sapiens
gccccaaccaccaca

SEQ ID NO: 73313 - DNA, 17 bp, Homo sapiens
gcgttccgggaagactt

SEQ ID NO: 73314 - DNA, 17 bp, Homo sapiens
gacacacagggtggctc

SEQ ID NO: 73315 - DNA, 17 bp, Homo sapiens
gacacacagggtggctt

SEQ ID NO: 73316 - DNA, 20 bp, Homo sapiens
tctggtctgcctcaggtaac

SEQ ID NO: 73317 - DNA, 24 bp, Homo sapiens
actgtaatttttttaaaggtcctg

SEQ ID NO: 73318 - DNA, 24 bp, Homo sapiens
actgtaatttttttaaaggtcctc

SEQ ID NO: 73319 - DNA, 30 bp, Homo sapiens
ggatgtatatcatctatcttcacagtatat

SEQ ID NO: 73320 - DNA, 22 bp, Homo sapiens
ggtaccatggactgtactcact

SEQ ID NO: 73321 - DNA, 21 bp, Homo sapiens
gtaccatggactgtactcacc

SEQ ID NO: 73322 - DNA, 20 bp, Homo sapiens
aggttggttctggagatgac

SEQ ID NO: 73323 - DNA, 21 bp, Homo sapiens
aattcaagacagtgcaacatc

SEQ ID NO: 73324 - DNA, 23 bp, Homo sapiens
taaattcaagacagtgcaacata

SEQ ID NO: 73325 - DNA, 22 bp, Homo sapiens
cacacaccgcactctaattact

SEQ ID NO: 73326 - DNA, 15 bp, Homo sapiens
aggtcgtgttgccgc

SEQ ID NO: 73327 - DNA, 16 bp, Homo sapiens
gaggtcgtgttgccgt

SEQ ID NO: 73328 - DNA, 22 bp, Homo sapiens
gcctctcaccactttctgtaag

SEQ ID NO: 73329 - DNA, 23 bp, Homo sapiens
gagcaccttaactatagatggtg

SEQ ID NO: 73330 - DNA, 24 bp, Homo sapiens
tgagcaccttaactatagatggta

SEQ ID NO: 73331 - DNA, 22 bp, Homo sapiens
cttgtcaaggcacagaataatt

SEQ ID NO: 73332 - DNA, 21 bp, Homo sapiens
tgaagaagctaaggattgagg

SEQ ID NO: 73333 - DNA, 21 bp, Homo sapiens
tgaagaagctaaggattgagc

SEQ ID NO: 73334 - DNA, 18 bp, Homo sapiens
ctctccctggctgagttg

SEQ ID NO: 73335 - DNA, 16 bp, Homo sapiens
cacggcgcactttctt

SEQ ID NO: 73336 - DNA, 16 bp, Homo sapiens
cacggcgcactttctc

SEQ ID NO: 73337 - DNA, 26 bp, Homo sapiens
tgttttttcctttgtcatcttatcta

SEQ ID NO: 73338 - DNA, 17 bp, Homo sapiens
gcactcttggacaagcg

SEQ ID NO: 73339 - DNA, 18 bp, Homo sapiens
tgcactcttggacaagca

SEQ ID NO: 73340 - DNA, 22 bp, Homo sapiens
aatgacatcccctatctttctg

SEQ ID NO: 73341 - DNA, 19 bp, Homo sapiens
gtaccttcacccatggaac

SEQ ID NO: 73342 - DNA, 19 bp, Homo sapiens
gtaccttcacccatggaat

SEQ ID NO: 73343 - DNA, 24 bp, Homo sapiens
tcactttctgttgattacatgaga

SEQ ID NO: 73344 - DNA, 17 bp, Homo sapiens
agtggagcttcagggct

SEQ ID NO: 73345 - DNA, 15 bp, Homo sapiens
tggagcttcagggcg

SEQ ID NO: 73346 - DNA, 23 bp, Homo sapiens
cagtggagacagaggatgtttac

SEQ ID NO: 73347 - DNA, 17 bp, Homo sapiens
cagccaagagcaggaca

SEQ ID NO: 73348 - DNA, 16 bp, Homo sapiens
agccaagagcaggacg

SEQ ID NO: 73349 - DNA, 20 bp, Homo sapiens
cccaagacacgttcagaaat

SEQ ID NO: 73350 - DNA, 19 bp, Homo sapiens
tctccctcctgttccttgt

SEQ ID NO: 73351 - DNA, 17 bp, Homo sapiens
tccctcctgttccttgc

SEQ ID NO: 73352 - DNA, 20 bp, Homo sapiens
gcaatgtgctgtgaatgaag

SEQ ID NO: 73353 - DNA, 17 bp, Homo sapiens
ttggtacctggctctct

SEQ ID NO: 73354 - DNA, 16 bp, Homo sapiens
tggtacctggctctcc

SEQ ID NO: 73355 - DNA, 26 bp, Homo sapiens
aaacttcttaggacagagtgattaga

SEQ ID NO: 73356 - DNA, 16 bp, Homo sapiens
cctcaggcaccgagag

SEQ ID NO: 73357 - DNA, 16 bp, Homo sapiens
cctcaggcaccgagac

SEQ ID NO: 73358 - DNA, 20 bp, Homo sapiens
ctggacctcctgatgatctc

SEQ ID NO: 73359 - DNA, 16 bp, Homo sapiens
ctggctgctccctgat

SEQ ID NO: 73360 - DNA, 16 bp, Homo sapiens
ctggctgctccctgac

SEQ ID NO: 73361 - DNA, 18 bp, Homo sapiens
gcctgactggctgatctc

SEQ ID NO: 73362 - DNA, 13 bp, Homo sapiens
gggtgcagaacct

SEQ ID NO: 73363 - DNA, 13 bp, Homo sapiens
gggtgcagaaccc

SEQ ID NO: 73364 - DNA, 16 bp, Homo sapiens
cagaccggcccacttg

SEQ ID NO: 73365 - DNA, 18 bp, Homo sapiens
ccatcttctacgcactgt

SEQ ID NO: 73366 - DNA, 16 bp, Homo sapiens
atcttctacgcactgc

SEQ ID NO: 73367 - DNA, 20 bp, Homo sapiens
cagcatagccaggaagaaga

SEQ ID NO: 73368 - DNA, 14 bp, Homo sapiens
gagcgggagcaacg

SEQ ID NO: 73369 - DNA, 15 bp, Homo sapiens
tgagcgggagcaaca

SEQ ID NO: 73370 - DNA, 17 bp, Homo sapiens
tggagctgcaggtgatc

SEQ ID NO: 73371 - DNA, 15 bp, Homo sapiens
cacggcggtcatgtg

SEQ ID NO: 73372 - DNA, 16 bp, Homo sapiens
ccacggcggtcatgta

SEQ ID NO: 73373 - DNA, 19 bp, Homo sapiens
gttttgtgggaggaaagag

SEQ ID NO: 73374 - DNA, 25 bp, Homo sapiens
cagttgtacccctacaataatgtac

SEQ ID NO: 73375 - DNA, 25 bp, Homo sapiens
cagttgtacccctacaataatgtaa

SEQ ID NO: 73376 - DNA, 21 bp, Homo sapiens
tcggtttctcttcattcattc

SEQ ID NO: 73377 - DNA, 18 bp, Homo sapiens
ggcgttcagtttttagcc

SEQ ID NO: 73378 - DNA, 18 bp, Homo sapiens
ggcgttcagtttttagcg

SEQ ID NO: 73379 - DNA, 20 bp, Homo sapiens
caatacgccagcaaaatacc

SEQ ID NO: 73380 - DNA, 20 bp, Homo sapiens
tgtcgaatgggagtcttctt

SEQ ID NO: 73381 - DNA, 20 bp, Homo sapiens
tgtcgaatgggagtcttctc

SEQ ID NO: 73382 - DNA, 20 bp, Homo sapiens
ggaagaaacagctacccaga

SEQ ID NO: 73383 - DNA, 21 bp, Homo sapiens
cctcctagagaagatctgcac

SEQ ID NO: 73384 - DNA, 21 bp, Homo sapiens
cctcctagagaagatctgcat

SEQ ID NO: 73385 - DNA, 18 bp, Homo sapiens
aaggcccctcttctgtct

SEQ ID NO: 73386 - DNA, 21 bp, Homo sapiens
agagaatgttacctctcctga

SEQ ID NO: 73387 - DNA, 20 bp, Homo sapiens
gagaatgttacctctcctgg

SEQ ID NO: 73388 - DNA, 20 bp, Homo sapiens
ttctcctgggtcagattctc

SEQ ID NO: 73389 - DNA, 15 bp, Homo sapiens
gcgcaccagcttcag

SEQ ID NO: 73390 - DNA, 15 bp, Homo sapiens
gcgcaccagcttcac

SEQ ID NO: 73391 - DNA, 25 bp, Homo sapiens
tgtaatacatgattttcagacacac

SEQ ID NO: 73392 - DNA, 17 bp, Homo sapiens
catcacggagatccacc

SEQ ID NO: 73393 - DNA, 19 bp, Homo sapiens
atcatcacggagatccact

SEQ ID NO: 73394 - DNA, 22 bp, Homo sapiens
tcagctccaaggagattcttag

SEQ ID NO: 73395 - DNA, 23 bp, Homo sapiens
gagcaccttaactatagatggtg

SEQ ID NO: 73396 - DNA, 24 bp, Homo sapiens
tgagcaccttaactatagatggta

SEQ ID NO: 73397 - DNA, 22 bp, Homo sapiens
cttgtcaaggcacagaataatt

SEQ ID NO: 73398 - DNA, 17 bp, Homo sapiens
ctggcagcgaatgttat

SEQ ID NO: 73399 - DNA, 17 bp, Homo sapiens
ctggcagcgaatgttac

SEQ ID NO: 73400 - DNA, 25 bp, Homo sapiens
cctctagaaagaaaatggactgtat

SEQ ID NO: 73401 - DNA, 16 bp, Homo sapiens
actcctttggactggc

SEQ ID NO: 73402 - DNA, 18 bp, Homo sapiens
tgactcctttggactggt

SEQ ID NO: 73403 - DNA, 22 bp, Homo sapiens
tcttaaatgctgtggaattgtg

SEQ ID NO: 73404 - DNA, 22 bp, Homo sapiens
gacctacgctccttcatctaac

SEQ ID NO: 73405 - DNA, 22 bp, Homo sapiens
gacctacgctccttcatctaat

SEQ ID NO: 73406 - DNA, 29 bp, Homo sapiens
caatgtgattacctcaaaataatatctac

SEQ ID NO: 73407 - DNA, 17 bp, Homo sapiens
agagagggtgaaggtgc

SEQ ID NO: 73408 - DNA, 18 bp, Homo sapiens
gagagagggtgaaggtgt

SEQ ID NO: 73409 - DNA, 22 bp, Homo sapiens
ccctttaaggctgttatctgac

SEQ ID NO: 73410 - DNA, 20 bp, Homo sapiens
accacttctatccgagtagc

SEQ ID NO: 73411 - DNA, 21 bp, Homo sapiens
gaccacttctatccgagtagt

SEQ ID NO: 73412 - DNA, 25 bp, Homo sapiens
gggaaaaatgtgtgtcttttaatta

SEQ ID NO: 73413 - DNA, 18 bp, Homo sapiens
ccctacagaggatgtcag

SEQ ID NO: 73414 - DNA, 18 bp, Homo sapiens
ccctacagaggatgtcaa

SEQ ID NO: 73415 - DNA, 18 bp, Homo sapiens
cagagcctcccttgtcac

SEQ ID NO: 73416 - DNA, 15 bp, Homo sapiens
cctgtcgggggagat

SEQ ID NO: 73417 - DNA, 15 bp, Homo sapiens
cctgtcgggggagac

SEQ ID NO: 73418 - DNA, 17 bp, Homo sapiens
gaagcggagcctgagaa

SEQ ID NO: 73419 - DNA, 20 bp, Homo sapiens
agaaactggctctgaagaca

SEQ ID NO: 73420 - DNA, 21 bp, Homo sapiens
cagaaactggctctgaagact

SEQ ID NO: 73421 - DNA, 20 bp, Homo sapiens
gaaagtgggcatgggtatac

SEQ ID NO: 73422 - DNA, 22 bp, Homo sapiens
ctttcgaagtttcagttgaact

SEQ ID NO: 73423 - DNA, 20 bp, Homo sapiens
ttcgaagtttcagttgaacc

SEQ ID NO: 73424 - DNA, 19 bp, Homo sapiens
gttttccagcttgcatgtc

SEQ ID NO: 73425 - DNA, 20 bp, Homo sapiens
cactatcgaagtccccaaat

SEQ ID NO: 73426 - DNA, 20 bp, Homo sapiens
cactatcgaagtccccaaag

SEQ ID NO: 73427 - DNA, 25 bp, Homo sapiens
catctggtttttgacaatcattata

SEQ ID NO: 73428 - DNA, 18 bp, Homo sapiens
ctcagggagggagagaga

SEQ ID NO: 73429 - DNA, 18 bp, Homo sapiens
ctcagggagggagagagt

SEQ ID NO: 73430 - DNA, 19 bp, Homo sapiens
acagctcaggcagaaactg

SEQ ID NO: 73431 - DNA, 18 bp, Homo sapiens
ctcagctgaacctggcta

SEQ ID NO: 73432 - DNA, 16 bp, Homo sapiens
cagctgaacctggctg

SEQ ID NO: 73433 - DNA, 20 bp, Homo sapiens
gaaacacctcctccatcttc

SEQ ID NO: 73434 - DNA, 17 bp, Homo sapiens
ccagaatgccttcatcg

SEQ ID NO: 73435 - DNA, 18 bp, Homo sapiens
gccagaatgccttcatct

SEQ ID NO: 73436 - DNA, 22 bp, Homo sapiens
gcatcacagcttgcttctataa

SEQ ID NO: 73437 - DNA, 23 bp, Homo sapiens
cttatgagattttctgtccagtc

SEQ ID NO: 73438 - DNA, 23 bp, Homo sapiens
cttatgagattttctgtccagtt

SEQ ID NO: 73439 - DNA, 20 bp, Homo sapiens
tggaattgcagatgaacaag

SEQ ID NO: 73440 - DNA, 17 bp, Homo sapiens
gcccccctctctgaaga

SEQ ID NO: 73441 - DNA, 16 bp, Homo sapiens
cccccctctctgaagg

SEQ ID NO: 73442 - DNA, 22 bp, Homo sapiens
ccagttcgtggtatgttcatct

SEQ ID NO: 73443 - DNA, 16 bp, Homo sapiens
ccactgttgccatgat

SEQ ID NO: 73444 - DNA, 16 bp, Homo sapiens
ccactgttgccatgac

SEQ ID NO: 73445 - DNA, 17 bp, Homo sapiens
ccttccggctccataag

SEQ ID NO: 73446 - DNA, 18 bp, Homo sapiens
ctctcagctcaagcctcc

SEQ ID NO: 73447 - DNA, 17 bp, Homo sapiens
tctcagctcaagcctcg

SEQ ID NO: 73448 - DNA, 17 bp, Homo sapiens
cctgcccacctgtctct

SEQ ID NO: 73449 - DNA, 18 bp, Homo sapiens
ctgaagcgcaaccataac

SEQ ID NO: 73450 - DNA, 18 bp, Homo sapiens
ctgaagcgcaaccataat

SEQ ID NO: 73451 - DNA, 22 bp, Homo sapiens
tcccatagaaaaatgcactaag

SEQ ID NO: 73452 - DNA, 20 bp, Homo sapiens
ggtaaagctccagcactgta

SEQ ID NO: 73453 - DNA, 20 bp, Homo sapiens
ggtaaagctccagcactgtc

SEQ ID NO: 73454 - DNA, 20 bp, Homo sapiens
tcagcagcaggttcacataa

SEQ ID NO: 73455 - DNA, 15 bp, Homo sapiens
tgggctccatcccac

SEQ ID NO: 73456 - DNA, 15 bp, Homo sapiens
tgggctccatcccat

SEQ ID NO: 73457 - DNA, 24 bp, Homo sapiens
ccaattctttttcttctttcagtt

SEQ ID NO: 73458 - DNA, 18 bp, Homo sapiens
cccacattctctctcctt

SEQ ID NO: 73459 - DNA, 18 bp, Homo sapiens
cccacattctctctcctc

SEQ ID NO: 73460 - DNA, 17 bp, Homo sapiens
tgaggagcgtgggtgac

SEQ ID NO: 73461 - DNA, 20 bp, Homo sapiens
ctctaacatcaccgtgtacg

SEQ ID NO: 73462 - DNA, 21 bp, Homo sapiens
cctctaacatcaccgtgtaca

SEQ ID NO: 73463 - DNA, 20 bp, Homo sapiens
gagctctgggtcagaactgt

SEQ ID NO: 73464 - DNA, 22 bp, Homo sapiens
ggtaccatggactgtactcact

SEQ ID NO: 73465 - DNA, 21 bp, Homo sapiens
gtaccatggactgtactcacc

SEQ ID NO: 73466 - DNA, 20 bp, Homo sapiens
aggttggttctggagatgac

SEQ ID NO: 73467 - DNA, 21 bp, Homo sapiens
aggaactacggcgatatctaa

SEQ ID NO: 73468 - DNA, 21 bp, Homo sapiens
aggaactacggcgatatctag

SEQ ID NO: 73469 - DNA, 18 bp, Homo sapiens
gggtttccctggacacat

SEQ ID NO: 73470 - DNA, 19 bp, Homo sapiens
gcacagcaccttatgtcca

SEQ ID NO: 73471 - DNA, 18 bp, Homo sapiens
cacagcaccttatgtccg

SEQ ID NO: 73472 - DNA, 24 bp, Homo sapiens
cctcttgagcattcatttgtaatt

SEQ ID NO: 73473 - DNA, 20 bp, Homo sapiens
caaatacatctcccaggatc

SEQ ID NO: 73474 - DNA, 20 bp, Homo sapiens
caaatacatctcccaggatt

SEQ ID NO: 73475 - DNA, 25 bp, Homo sapiens
gttttaattgcagtttgaatgatat

SEQ ID NO: 73476 - DNA, 18 bp, Homo sapiens
tccaaaaggacctgacat

SEQ ID NO: 73477 - DNA, 18 bp, Homo sapiens
tccaaaaggacctgacac

SEQ ID NO: 73478 - DNA, 18 bp, Homo sapiens
ggctgcagaatggaattt

SEQ ID NO: 73479 - DNA, 13 bp, Homo sapiens
gcgcgtcttcccc

SEQ ID NO: 73480 - DNA, 14 bp, Homo sapiens
cgcgcgtcttccct

SEQ ID NO: 73481 - DNA, 20 bp, Homo sapiens
tcacgtgcttgacgattatc

SEQ ID NO: 73482 - DNA, 13 bp, Homo sapiens
gctgggccgtctg

SEQ ID NO: 73483 - DNA, 14 bp, Homo sapiens
agctgggccgtcta

SEQ ID NO: 73484 - DNA, 17 bp, Homo sapiens
caccgctcatggacaca

SEQ ID NO: 73485 - DNA, 17 bp, Homo sapiens
aaccccattcccttgag

SEQ ID NO: 73486 - DNA, 17 bp, Homo sapiens
aaccccattcccttgac

SEQ ID NO: 73487 - DNA, 21 bp, Homo sapiens
aggaactccctttggagatat

SEQ ID NO: 73488 - DNA, 23 bp, Homo sapiens
aacaatagaacatcttttcacaa

SEQ ID NO: 73489 - DNA, 23 bp, Homo sapiens
aacaatagaacatcttttcacag

SEQ ID NO: 73490 - DNA, 21 bp, Homo sapiens
ccaaacaccaacttgatcatc

SEQ ID NO: 73491 - DNA, 17 bp, Homo sapiens
gcattccaggttgagag

SEQ ID NO: 73492 - DNA, 17 bp, Homo sapiens
gcattccaggttgagaa

SEQ ID NO: 73493 - DNA, 19 bp, Homo sapiens
cgcacctggagtgatagac

SEQ ID NO: 73494 - DNA, 18 bp, Homo sapiens
gaagtcattctgctctgc

SEQ ID NO: 73495 - DNA, 20 bp, Homo sapiens
atgaagtcattctgctctgt

SEQ ID NO: 73496 - DNA, 25 bp, Homo sapiens
tttccatctcctaactcttttctag

SEQ ID NO: 73497 - DNA, 18 bp, Homo sapiens
acaagtgtctggctgagg

SEQ ID NO: 73498 - DNA, 19 bp, Homo sapiens
cacaagtgtctggctgaga

SEQ ID NO: 73499 - DNA, 23 bp, Homo sapiens
tgcctcagacactgagaaattat

SEQ ID NO: 73500 - DNA, 17 bp, Homo sapiens
aaggcaggatgggagtg

SEQ ID NO: 73501 - DNA, 18 bp, Homo sapiens
aaaggcaggatgggagtt

SEQ ID NO: 73502 - DNA, 22 bp, Homo sapiens
cgtcaaagcactaatgtcatgt

SEQ ID NO: 73503 - DNA, 23 bp, Homo sapiens
cttcaacttggaaagacatctta

SEQ ID NO: 73504 - DNA, 21 bp, Homo sapiens
tcaacttggaaagacatcttg

SEQ ID NO: 73505 - DNA, 26 bp, Homo sapiens
cttgaaagggtagaagtaagacatat

SEQ ID NO: 73506 - DNA, 17 bp, Homo sapiens
gctgggagctttcctgt

SEQ ID NO: 73507 - DNA, 16 bp, Homo sapiens
ctgggagctttcctgg

SEQ ID NO: 73508 - DNA, 19 bp, Homo sapiens
caggacagcactggtgtct

SEQ ID NO: 73509 - DNA, 17 bp, Homo sapiens
gctgtgctgctggtaca

SEQ ID NO: 73510 - DNA, 18 bp, Homo sapiens
ggctgtgctgctggtact

SEQ ID NO: 73511 - DNA, 20 bp, Homo sapiens
ggcatgacctctgacatctc

SEQ ID NO: 73512 - DNA, 29 bp, Homo sapiens
gggtagtaccaaaaatattacttactttc

SEQ ID NO: 73513 - DNA, 29 bp, Homo sapiens
gggtagtaccaaaaatattacttacttta

SEQ ID NO: 73514 - DNA, 23 bp, Homo sapiens
ccaagtggagaagtgactagaca

SEQ ID NO: 73515 - DNA, 17 bp, Homo sapiens
agggaaaccccagagag

SEQ ID NO: 73516 - DNA, 17 bp, Homo sapiens
agggaaaccccagagaa

SEQ ID NO: 73517 - DNA, 22 bp, Homo sapiens
acaagttcatttgtgaatgtga

SEQ ID NO: 73518 - DNA, 18 bp, Homo sapiens
gcaggtggcgtatctgtc

SEQ ID NO: 73519 - DNA, 18 bp, Homo sapiens
gcaggtggcgtatctgtt

SEQ ID NO: 73520 - DNA, 17 bp, Homo sapiens
cggcctggaaccttagc

SEQ ID NO: 73521 - DNA, 17 bp, Homo sapiens
cacaatcaccacggtct

SEQ ID NO: 73522 - DNA, 16 bp, Homo sapiens
acaatcaccacggtcc

SEQ ID NO: 73523 - DNA, 20 bp, Homo sapiens
ccttctgcatcagcatcttc

SEQ ID NO: 73524 - DNA, 15 bp, Homo sapiens
accccccgaagaacc

SEQ ID NO: 73525 - DNA, 14 bp, Homo sapiens
ccccccgaagaacg

SEQ ID NO: 73526 - DNA, 18 bp, Homo sapiens
gcgtggagatcctgactc

SEQ ID NO: 73527 - DNA, 17 bp, Homo sapiens
agtggccaagaacacca

SEQ ID NO: 73528 - DNA, 15 bp, Homo sapiens
tggccaagaacaccg

SEQ ID NO: 73529 - DNA, 20 bp, Homo sapiens
ggtatgaggcaaagttcctg

SEQ ID NO: 73530 - DNA, 21 bp, Homo sapiens
gttgaaaatgtgaatcagcac

SEQ ID NO: 73531 - DNA, 21 bp, Homo sapiens
gttgaaaatgtgaatcagcag

SEQ ID NO: 73532 - DNA, 19 bp, Homo sapiens
tgcagagcttccaagtttt

SEQ ID NO: 73533 - DNA, 18 bp, Homo sapiens
gggtctcccactccatac

SEQ ID NO: 73534 - DNA, 17 bp, Homo sapiens
ggtctcccactccatat

SEQ ID NO: 73535 - DNA, 20 bp, Homo sapiens
gggcccattaactcacatac

SEQ ID NO: 73536 - DNA, 16 bp, Homo sapiens
gcctcccggaggactt

SEQ ID NO: 73537 - DNA, 16 bp, Homo sapiens
gcctcccggaggactc

SEQ ID NO: 73538 - DNA, 23 bp, Homo sapiens
ggaactaaccatggcttctctta

SEQ ID NO: 73539 - DNA, 16 bp, Homo sapiens
gggaccggatcagcac

SEQ ID NO: 73540 - DNA, 16 bp, Homo sapiens
gggaccggatcagcat

SEQ ID NO: 73541 - DNA, 24 bp, Homo sapiens
ggcagtaggatgaattagaaagtg

SEQ ID NO: 73542 - DNA, 21 bp, Homo sapiens
cacaccagcaatgatgaaact

SEQ ID NO: 73543 - DNA, 19 bp, Homo sapiens
caccagcaatgatgaaacc

SEQ ID NO: 73544 - DNA, 21 bp, Homo sapiens
gggctaactctttgcatgttc

SEQ ID NO: 73545 - DNA, 17 bp, Homo sapiens
cggaatcgaaacgtgag

SEQ ID NO: 73546 - DNA, 17 bp, Homo sapiens
cggaatcgaaacgtgaa

SEQ ID NO: 73547 - DNA, 20 bp, Homo sapiens
gcacctctcggagtgtatct

SEQ ID NO: 73548 - DNA, 21 bp, Homo sapiens
tttcaagctgtctcctaccat

SEQ ID NO: 73549 - DNA, 21 bp, Homo sapiens
tttcaagctgtctcctaccac

SEQ ID NO: 73550 - DNA, 22 bp, Homo sapiens
ggagagaagggaaggactaaag

SEQ ID NO: 73551 - DNA, 22 bp, Homo sapiens
agtttgaggatgatgctattag

SEQ ID NO: 73552 - DNA, 22 bp, Homo sapiens
agtttgaggatgatgctattaa

SEQ ID NO: 73553 - DNA, 25 bp, Homo sapiens
agtgggttattgtcactttttctat

SEQ ID NO: 73554 - DNA, 24 bp, Homo sapiens
aggttgtacctgtagcactaagac

SEQ ID NO: 73555 - DNA, 25 bp, Homo sapiens
taggttgtacctgtagcactaagat

SEQ ID NO: 73556 - DNA, 21 bp, Homo sapiens
tgggctcctcagagaaaatat

SEQ ID NO: 73557 - DNA, 21 bp, Homo sapiens
aagataagcctgtcactggtc

SEQ ID NO: 73558 - DNA, 21 bp, Homo sapiens
aagataagcctgtcactggtt

SEQ ID NO: 73559 - DNA, 22 bp, Homo sapiens
caagccagcctaataaacataa

SEQ ID NO: 73560 - DNA, 21 bp, Homo sapiens
tgagtgtctcagtttctagca

SEQ ID NO: 73561 - DNA, 20 bp, Homo sapiens
gagtgtctcagtttctagcc

SEQ ID NO: 73562 - DNA, 25 bp, Homo sapiens
ctgaagaggacatgtcaaatattac

SEQ ID NO: 73563 - DNA, 22 bp, Homo sapiens
gaaacatcaaaattctccagac

SEQ ID NO: 73564 - DNA, 22 bp, Homo sapiens
gaaacatcaaaattctccagat

SEQ ID NO: 73565 - DNA, 24 bp, Homo sapiens
tgggtattgcatttttaagtttag

SEQ ID NO: 73566 - DNA, 18 bp, Homo sapiens
ggccactttgcctgaata

SEQ ID NO: 73567 - DNA, 18 bp, Homo sapiens
ggccactttgcctgaatt

SEQ ID NO: 73568 - DNA, 25 bp, Homo sapiens
cgaaatgttcatttttaaagtcaga

SEQ ID NO: 73569 - DNA, 16 bp, Homo sapiens
atggccaactccttca

SEQ ID NO: 73570 - DNA, 15 bp, Homo sapiens
tggccaactccttcg

SEQ ID NO: 73571 - DNA, 18 bp, Homo sapiens
ggtccatgctccagatga

SEQ ID NO: 73572 - DNA, 18 bp, Homo sapiens
cctctccacagcgttttg

SEQ ID NO: 73573 - DNA, 18 bp, Homo sapiens
cctctccacagcgttttc

SEQ ID NO: 73574 - DNA, 15 bp, Homo sapiens
gcagcggccacagag

SEQ ID NO: 73575 - DNA, 17 bp, Homo sapiens
gtgtcttcccccaccac

SEQ ID NO: 73576 - DNA, 17 bp, Homo sapiens
gtgtcttcccccaccat

SEQ ID NO: 73577 - DNA, 15 bp, Homo sapiens
tgcggcagcaactga

SEQ ID NO: 73578 - DNA, 18 bp, Homo sapiens
gcccagagacaggaaaat

SEQ ID NO: 73579 - DNA, 18 bp, Homo sapiens
gcccagagacaggaaaac

SEQ ID NO: 73580 - DNA, 16 bp, Homo sapiens
gcctgccctctgttca

SEQ ID NO: 73581 - DNA, 18 bp, Homo sapiens
atctacaccattgcacac

SEQ ID NO: 73582 - DNA, 19 bp, Homo sapiens
catctacaccattgcacat

SEQ ID NO: 73583 - DNA, 18 bp, Homo sapiens
gcctcctcccttttcagt

SEQ ID NO: 73584 - DNA, 14 bp, Homo sapiens
cgctgcagggtcat

SEQ ID NO: 73585 - DNA, 14 bp, Homo sapiens
cgctgcagggtcac

SEQ ID NO: 73586 - DNA, 18 bp, Homo sapiens
cctccccgcagagaatta

SEQ ID NO: 73587 - DNA, 18 bp, Homo sapiens
tgtcctggttctgctcag

SEQ ID NO: 73588 - DNA, 19 bp, Homo sapiens
atgtcctggttctgctcat

SEQ ID NO: 73589 - DNA, 19 bp, Homo sapiens
ctggtctccttcgttcaga

SEQ ID NO: 73590 - DNA, 16 bp, Homo sapiens
ggtgttcctggcttcc

SEQ ID NO: 73591 - DNA, 16 bp, Homo sapiens
ggtgttcctggcttcg

SEQ ID NO: 73592 - DNA, 25 bp, Homo sapiens
ggagaacctaacaaggattttacta

SEQ ID NO: 73593 - DNA, 25 bp, Homo sapiens
aagaatttgaacttactgatgagac

SEQ ID NO: 73594 - DNA, 26 bp, Homo sapiens
taagaatttgaacttactgatgagat

SEQ ID NO: 73595 - DNA, 24 bp, Homo sapiens
atgtggagtttgatttccttatta

SEQ ID NO: 73596 - DNA, 23 bp, Homo sapiens
agtcaaaatggacacaatcttct

SEQ ID NO: 73597 - DNA, 20 bp, Homo sapiens
caaaatggacacaatcttcg

SEQ ID NO: 73598 - DNA, 24 bp, Homo sapiens
tgagataaggaaacctcttgataa

SEQ ID NO: 73599 - DNA, 21 bp, Homo sapiens
cctggatgaggaatcctactg

SEQ ID NO: 73600 - DNA, 21 bp, Homo sapiens
cctggatgaggaatcctactc

SEQ ID NO: 73601 - DNA, 19 bp, Homo sapiens
gctgccgtacctgttgtag

SEQ ID NO: 73602 - DNA, 17 bp, Homo sapiens
cccactgttgccatgac

SEQ ID NO: 73603 - DNA, 17 bp, Homo sapiens
cccactgttgccatgat

SEQ ID NO: 73604 - DNA, 17 bp, Homo sapiens
ccttccggctccataag

SEQ ID NO: 73605 - DNA, 15 bp, Homo sapiens
ctcgcagcggtcagt

SEQ ID NO: 73606 - DNA, 14 bp, Homo sapiens
tcgcagcggtcagc

SEQ ID NO: 73607 - DNA, 16 bp, Homo sapiens
gctggcgggaatttct

SEQ ID NO: 73608 - DNA, 14 bp, Homo sapiens
gcagcgaccatgag

SEQ ID NO: 73609 - DNA, 14 bp, Homo sapiens
gcagcgaccatgac

SEQ ID NO: 73610 - DNA, 18 bp, Homo sapiens
tcctctgcctccactctg

SEQ ID NO: 73611 - DNA, 20 bp, Homo sapiens
gtgatagtggtggagagtgg

SEQ ID NO: 73612 - DNA, 21 bp, Homo sapiens
tgtgatagtggtggagagtgt

SEQ ID NO: 73613 - DNA, 25 bp, Homo sapiens
actgagcttgattttctcttttaat

SEQ ID NO: 73614 - DNA, 23 bp, Homo sapiens
gatggtgaagtcctttatctctg

SEQ ID NO: 73615 - DNA, 23 bp, Homo sapiens
gatggtgaagtcctttatctctc

SEQ ID NO: 73616 - DNA, 20 bp, Homo sapiens
agcacaatttgcaatcacac

SEQ ID NO: 73617 - DNA, 18 bp, Homo sapiens
cacgacgatcccttctga

SEQ ID NO: 73618 - DNA, 18 bp, Homo sapiens
cacgacgatcccttctgt

SEQ ID NO: 73619 - DNA, 15 bp, Homo sapiens
gggcgcagctgtctg

SEQ ID NO: 73620 - DNA, 21 bp, Homo sapiens
gaatctcatgttcaggaaatg

SEQ ID NO: 73621 - DNA, 22 bp, Homo sapiens
cgaatctcatgttcaggaaata

SEQ ID NO: 73622 - DNA, 17 bp, Homo sapiens
gccatggcccataaaac

SEQ ID NO: 73623 - DNA, 16 bp, Homo sapiens
cccaacccattgctcc

SEQ ID NO: 73624 - DNA, 17 bp, Homo sapiens
gcccaacccattgctct

SEQ ID NO: 73625 - DNA, 21 bp, Homo sapiens
tgtcagcacagaatccactac

SEQ ID NO: 73626 - DNA, 21 bp, Homo sapiens
ctactttatcacctggcatca

SEQ ID NO: 73627 - DNA, 18 bp, Homo sapiens
ctttatcacctggcatcg

SEQ ID NO: 73628 - DNA, 25 bp, Homo sapiens
cacctcaagtctgtgaagtacttac

SEQ ID NO: 73629 - DNA, 17 bp, Homo sapiens
gaggcagtgactaaggt

SEQ ID NO: 73630 - DNA, 16 bp, Homo sapiens
aggcagtgactaaggc

SEQ ID NO: 73631 - DNA, 22 bp, Homo sapiens
gcatgtcagaatcctcaatctc

SEQ ID NO: 73632 - DNA, 20 bp, Homo sapiens
catggagtcaactcttgagg

SEQ ID NO: 73633 - DNA, 21 bp, Homo sapiens
gcatggagtcaactcttgagt

SEQ ID NO: 73634 - DNA, 20 bp, Homo sapiens
ggctgtgctttgtctgatct

SEQ ID NO: 73635 - DNA, 23 bp, Homo sapiens
gtatgacctgtacttctggagac

SEQ ID NO: 73636 - DNA, 23 bp, Homo sapiens
gtatgacctgtacttctggagaa

SEQ ID NO: 73637 - DNA, 18 bp, Homo sapiens
aggccccctctcaatact

SEQ ID NO: 73638 - DNA, 18 bp, Homo sapiens
tgctggagcaattgagag

SEQ ID NO: 73639 - DNA, 19 bp, Homo sapiens
ctgctggagcaattgagat

SEQ ID NO: 73640 - DNA, 19 bp, Homo sapiens
tcttcccctcgtttctttc

SEQ ID NO: 73641 - DNA, 20 bp, Homo sapiens
ggtcatggccttagagactg

SEQ ID NO: 73642 - DNA, 20 bp, Homo sapiens
ggtcatggccttagagacta

SEQ ID NO: 73643 - DNA, 19 bp, Homo sapiens
ggccgaccatagagatgag

SEQ ID NO: 73644 - DNA, 17 bp, Homo sapiens
cctagtcctgggcctga

SEQ ID NO: 73645 - DNA, 17 bp, Homo sapiens
cctagtcctgggcctgg

SEQ ID NO: 73646 - DNA, 17 bp, Homo sapiens
cgccacctgctgaaaca

SEQ ID NO: 73647 - DNA, 22 bp, Homo sapiens
agatgcaacagagaattttctc

SEQ ID NO: 73648 - DNA, 21 bp, Homo sapiens
gatgcaacagagaattttctg

SEQ ID NO: 73649 - DNA, 25 bp, Homo sapiens
ctctgttctttcaattctttagatg

SEQ ID NO: 73650 - DNA, 28 bp, Homo sapiens
aatacacagtcttgttttagaattttaa

SEQ ID NO: 73651 - DNA, 28 bp, Homo sapiens
aatacacagtcttgttttagaattttag

SEQ ID NO: 73652 - DNA, 26 bp, Homo sapiens
aaatgaggatgtctacacagctatat

SEQ ID NO: 73653 - DNA, 16 bp, Homo sapiens
aggagctggaggagaa

SEQ ID NO: 73654 - DNA, 16 bp, Homo sapiens
aggagctggaggagac

SEQ ID NO: 73655 - DNA, 21 bp, Homo sapiens
gagacctcaactttgtttaga

SEQ ID NO: 73656 - DNA, 22 bp, Homo sapiens
ctgttgaagaaagcgtacctag

SEQ ID NO: 73657 - DNA, 22 bp, Homo sapiens
ctgttgaagaaagcgtacctac

SEQ ID NO: 73658 - DNA, 21 bp, Homo sapiens
tgcaagcagttgtttttatga

SEQ ID NO: 73659 - DNA, 16 bp, Homo sapiens
gcagccagtttctccc

SEQ ID NO: 73660 - DNA, 17 bp, Homo sapiens
tgcagccagtttctcct

SEQ ID NO: 73661 - DNA, 21 bp, Homo sapiens
catgaaatgcttccaggtatt

SEQ ID NO: 73662 - DNA, 20 bp, Homo sapiens
gttccaaccagaagagaatg

SEQ ID NO: 73663 - DNA, 21 bp, Homo sapiens
ggttccaaccagaagagaata

SEQ ID NO: 73664 - DNA, 18 bp, Homo sapiens
cttgcccccaacagttag

SEQ ID NO: 73665 - DNA, 22 bp, Homo sapiens
cggtttaccttgacattatttc

SEQ ID NO: 73666 - DNA, 22 bp, Homo sapiens
cggtttaccttgacattatttt

SEQ ID NO: 73667 - DNA, 22 bp, Homo sapiens
gactgttgccccttatctatgt

SEQ ID NO: 73668 - DNA, 19 bp, Homo sapiens
ctgaaacttccgtggtaga

SEQ ID NO: 73669 - DNA, 17 bp, Homo sapiens
gaaacttccgtggtagg

SEQ ID NO: 73670 - DNA, 20 bp, Homo sapiens
gatcagtccctggttctgaa

SEQ ID NO: 73671 - DNA, 20 bp, Homo sapiens
accttcaaagccttcagatc

SEQ ID NO: 73672 - DNA, 19 bp, Homo sapiens
ccttcaaagccttcagatg

SEQ ID NO: 73673 - DNA, 23 bp, Homo sapiens
gtggttttggcttgattttatat

SEQ ID NO: 73674 - DNA, 18 bp, Homo sapiens
ctgattctgccccttttt

SEQ ID NO: 73675 - DNA, 18 bp, Homo sapiens
ctgattctgccccttttc

SEQ ID NO: 73676 - DNA, 22 bp, Homo sapiens
tacatggaagcctgagacttac

SEQ ID NO: 73677 - DNA, 21 bp, Homo sapiens
ttctccagaaacttgaccatc

SEQ ID NO: 73678 - DNA, 22 bp, Homo sapiens
cttctccagaaacttgaccata

SEQ ID NO: 73679 - DNA, 25 bp, Homo sapiens
gaagatgatggtaaacctgagttat

SEQ ID NO: 73680 - DNA, 19 bp, Homo sapiens
caaagccatggtctttcat

SEQ ID NO: 73681 - DNA, 19 bp, Homo sapiens
caaagccatggtctttcac

SEQ ID NO: 73682 - DNA, 19 bp, Homo sapiens
ccgctcttcggttctactc

SEQ ID NO: 73683 - DNA, 17 bp, Homo sapiens
tggacgtgggctttttc

SEQ ID NO: 73684 - DNA, 17 bp, Homo sapiens
tggacgtgggctttttt

SEQ ID NO: 73685 - DNA, 18 bp, Homo sapiens
gctgcagccctttttctc

SEQ ID NO: 73686 - DNA, 18 bp, Homo sapiens
cagcaagtggagtttcca

SEQ ID NO: 73687 - DNA, 17 bp, Homo sapiens
agcaagtggagtttccg

SEQ ID NO: 73688 - DNA, 16 bp, Homo sapiens
gagggcagtgccagtg

SEQ ID NO: 73689 - DNA, 22 bp, Homo sapiens
tcacactcttccatattgtctg

SEQ ID NO: 73690 - DNA, 23 bp, Homo sapiens
gtcacactcttccatattgtctc

SEQ ID NO: 73691 - DNA, 23 bp, Homo sapiens
aacaatcctcacacatctctctt

SEQ ID NO: 73692 - DNA, 20 bp, Homo sapiens
gctgacttttttgctctttc

SEQ ID NO: 73693 - DNA, 20 bp, Homo sapiens
gctgacttttttgctctttg

SEQ ID NO: 73694 - DNA, 23 bp, Homo sapiens
gccattttccacaataaatattt

SEQ ID NO: 73695 - DNA, 25 bp, Homo sapiens
tgaactttttctcagattcagtaac

SEQ ID NO: 73696 - DNA, 25 bp, Homo sapiens
tgaactttttctcagattcagtaaa

SEQ ID NO: 73697 - DNA, 21 bp, Homo sapiens
gaccacagcatcaaagaatgt

SEQ ID NO: 73698 - DNA, 18 bp, Homo sapiens
gttctgagccactaagcg

SEQ ID NO: 73699 - DNA, 19 bp, Homo sapiens
ggttctgagccactaagca

SEQ ID NO: 73700 - DNA, 21 bp, Homo sapiens
tccccactttctcattcttct

SEQ ID NO: 73701 - DNA, 22 bp, Homo sapiens
agaattgtgtccaaagaagttg

SEQ ID NO: 73702 - DNA, 23 bp, Homo sapiens
aagaattgtgtccaaagaagttt

SEQ ID NO: 73703 - DNA, 27 bp, Homo sapiens
aactggtataatttgaatcacataaat

SEQ ID NO: 73704 - DNA, 16 bp, Homo sapiens
tgctcctgaccgcagt

SEQ ID NO: 73705 - DNA, 15 bp, Homo sapiens
gctcctgaccgcagg

SEQ ID NO: 73706 - DNA, 20 bp, Homo sapiens
gggaggtcagcttttacaaa

SEQ ID NO: 73707 - DNA, 15 bp, Homo sapiens
gggaatgcggatggt

SEQ ID NO: 73708 - DNA, 14 bp, Homo sapiens
ggaatgcggatggg

SEQ ID NO: 73709 - DNA, 15 bp, Homo sapiens
ccaggcgtcggaact

SEQ ID NO: 73710 - DNA, 15 bp, Homo sapiens
tccgagcccacatcc

SEQ ID NO: 73711 - DNA, 15 bp, Homo sapiens
tccgagcccacatcg

SEQ ID NO: 73712 - DNA, 20 bp, Homo sapiens
catggaggagctgagaacac

SEQ ID NO: 73713 - DNA, 17 bp, Homo sapiens
cacctcctcatcccaca

SEQ ID NO: 73714 - DNA, 16 bp, Homo sapiens
acctcctcatcccacg

SEQ ID NO: 73715 - DNA, 16 bp, Homo sapiens
cctccccctccacaag

SEQ ID NO: 73716 - DNA, 19 bp, Homo sapiens
tgaatggcatccacaaaat

SEQ ID NO: 73717 - DNA, 19 bp, Homo sapiens
tgaatggcatccacaaaac

SEQ ID NO: 73718 - DNA, 22 bp, Homo sapiens
ccaaaagctaaaaagcacatct

SEQ ID NO: 73719 - DNA, 17 bp, Homo sapiens
gcatcacctgcatcctc

SEQ ID NO: 73720 - DNA, 17 bp, Homo sapiens
gcatcacctgcatcctt

SEQ ID NO: 73721 - DNA, 18 bp, Homo sapiens
tggattggttgctgttca

SEQ ID NO: 73722 - DNA, 19 bp, Homo sapiens
taccacagcttgctcacat

SEQ ID NO: 73723 - DNA, 19 bp, Homo sapiens
taccacagcttgctcacac

SEQ ID NO: 73724 - DNA, 19 bp, Homo sapiens
tttcccccatttttcagtt

SEQ ID NO: 73725 - DNA, 30 bp, Homo sapiens
cccggctgggcgcggacatggaggacgttc

SEQ ID NO: 73726 - DNA, 30 bp, Homo sapiens
cccggctgggcgcggacatggaggacgttt

SEQ ID NO: 73727 - DNA, 15 bp, Homo sapiens
cagcttgcgcaggtg

SEQ ID NO: 73728 - DNA, 22 bp, Homo sapiens
caaatagatggaaactactcca

SEQ ID NO: 73729 - DNA, 21 bp, Homo sapiens
aaatagatggaaactactccg

SEQ ID NO: 73730 - DNA, 18 bp, Homo sapiens
ggcagcccataggtttct

SEQ ID NO: 73731 - DNA, 18 bp, Homo sapiens
ctggaaatggttatgggc

SEQ ID NO: 73732 - DNA, 20 bp, Homo sapiens
tactggaaatggttatggga

SEQ ID NO: 73733 - DNA, 24 bp, Homo sapiens
tttataggcgtgaaactaattctc

SEQ ID NO: 73734 - DNA, 14 bp, Homo sapiens
cgctgcgcgtgttc

SEQ ID NO: 73735 - DNA, 14 bp, Homo sapiens
cgctgcgcgtgttt

SEQ ID NO: 73736 - DNA, 20 bp, Homo sapiens
ggaggaagggaaaggtacag

SEQ ID NO: 73737 - DNA, 15 bp, Homo sapiens
gcagatcgagttccg

SEQ ID NO: 73738 - DNA, 16 bp, Homo sapiens
ggcagatcgagttcca

SEQ ID NO: 73739 - DNA, 24 bp, Homo sapiens
cctaaactccatgaagaagacatt

SEQ ID NO: 73740 - DNA, 20 bp, Homo sapiens
ctgcattatttctatgacgc

SEQ ID NO: 73741 - DNA, 22 bp, Homo sapiens
ttctgcattatttctatgacgt

SEQ ID NO: 73742 - DNA, 22 bp, Homo sapiens
caaaaaatgccaacagtttaga

SEQ ID NO: 73743 - DNA, 20 bp, Homo sapiens
gttctcccctttcagtgtct

SEQ ID NO: 73744 - DNA, 18 bp, Homo sapiens
tctcccctttcagtgtcc

SEQ ID NO: 73745 - DNA, 21 bp, Homo sapiens
tgtcggtgactgttctgttaa

SEQ ID NO: 73746 - DNA, 14 bp, Homo sapiens
gcattcccgagggg

SEQ ID NO: 73747 - DNA, 15 bp, Homo sapiens
tgcattcccgagggt

SEQ ID NO: 73748 - DNA, 23 bp, Homo sapiens
tttccttcaggagttgatctcta

SEQ ID NO: 73749 - DNA, 20 bp, Homo sapiens
gccatacacctctttcagga

SEQ ID NO: 73750 - DNA, 19 bp, Homo sapiens
ccatacacctctttcaggg

SEQ ID NO: 73751 - DNA, 20 bp, Homo sapiens
ccaggaggcatgttgataag

SEQ ID NO: 73752 - DNA, 21 bp, Homo sapiens
agttcctgaccttcacatacc

SEQ ID NO: 73753 - DNA, 22 bp, Homo sapiens
aagttcctgaccttcacatact

SEQ ID NO: 73754 - DNA, 22 bp, Homo sapiens
ctatgtcagcatttgcatctaa

SEQ ID NO: 73755 - DNA, 15 bp, Homo sapiens
gcgtgagggtgagcg

SEQ ID NO: 73756 - DNA, 15 bp, Homo sapiens
gcgtgagggtgagca

SEQ ID NO: 73757 - DNA, 23 bp, Homo sapiens
gctaaggtgacccaaactcttac

SEQ ID NO: 73758 - DNA, 18 bp, Homo sapiens
acagcacagacttcaccg

SEQ ID NO: 73759 - DNA, 19 bp, Homo sapiens
gacagcacagacttcacca

SEQ ID NO: 73760 - DNA, 16 bp, Homo sapiens
gccattccccacagtg

SEQ ID NO: 73761 - DNA, 22 bp, Homo sapiens
agacaaattctctcatgtccac

SEQ ID NO: 73762 - DNA, 22 bp, Homo sapiens
agacaaattctctcatgtccat

SEQ ID NO: 73763 - DNA, 24 bp, Homo sapiens
tgtttttccaggaaaaagatattc

SEQ ID NO: 73764 - DNA, 23 bp, Homo sapiens
ttctacccaggtacttatcatcc

SEQ ID NO: 73765 - DNA, 25 bp, Homo sapiens
ctttctacccaggtacttatcatct

SEQ ID NO: 73766 - DNA, 24 bp, Homo sapiens
ggattcactgtgaaagaacagtat

SEQ ID NO: 73767 - DNA, 22 bp, Homo sapiens
gaggtcttgaaatacagggatt

SEQ ID NO: 73768 - DNA, 22 bp, Homo sapiens
gaggtcttgaaatacagggatc

SEQ ID NO: 73769 - DNA, 24 bp, Homo sapiens
tcttgagaggtgtgatcataactt

SEQ ID NO: 73770 - DNA, 18 bp, Homo sapiens
aatggccttggacttgat

SEQ ID NO: 73771 - DNA, 18 bp, Homo sapiens
aatggccttggacttgac

SEQ ID NO: 73772 - DNA, 18 bp, Homo sapiens
ctctgccatgcaaaacac

SEQ ID NO: 73773 - DNA, 15 bp, Homo sapiens
gcgaggacgaagggg

SEQ ID NO: 73774 - DNA, 15 bp, Homo sapiens
gcgaggacgaagggc

SEQ ID NO: 73775 - DNA, 21 bp, Homo sapiens
ggaggatgaatggacagacaa

SEQ ID NO: 73776 - DNA, 17 bp, Homo sapiens
ccgacccgaactaaagg

SEQ ID NO: 73777 - DNA, 17 bp, Homo sapiens
ccgacccgaactaaagc

SEQ ID NO: 73778 - DNA, 15 bp, Homo sapiens
cgcgttccccatgtc

SEQ ID NO: 73779 - DNA, 19 bp, Homo sapiens
ccctcagtgtgactgagat

SEQ ID NO: 73780 - DNA, 19 bp, Homo sapiens
ccctcagtgtgactgagac

SEQ ID NO: 73781 - DNA, 19 bp, Homo sapiens
ccaggcatttcccatacag

SEQ ID NO: 73782 - DNA, 20 bp, Homo sapiens
tccacatcaggaaaaacagt

SEQ ID NO: 73783 - DNA, 19 bp, Homo sapiens
ccacatcaggaaaaacagc

SEQ ID NO: 73784 - DNA, 22 bp, Homo sapiens
catttgccaatgagaaatatca

SEQ ID NO: 73785 - DNA, 17 bp, Homo sapiens
ccaagctgaaaggcaag

SEQ ID NO: 73786 - DNA, 17 bp, Homo sapiens
ccaagctgaaaggcaat

SEQ ID NO: 73787 - DNA, 17 bp, Homo sapiens
cagccagggtggagagt

SEQ ID NO: 73788 - DNA, 19 bp, Homo sapiens
ccaaccgagatcagattga

SEQ ID NO: 73789 - DNA, 18 bp, Homo sapiens
caaccgagatcagattgg

SEQ ID NO: 73790 - DNA, 21 bp, Homo sapiens
tgatgctgattgtggatgata

SEQ ID NO: 73791 - DNA, 16 bp, Homo sapiens
cccaggcccagttcat

SEQ ID NO: 73792 - DNA, 16 bp, Homo sapiens
cccaggcccagttcac

SEQ ID NO: 73793 - DNA, 20 bp, Homo sapiens
catgtctgggctggagagta

SEQ ID NO: 73794 - DNA, 17 bp, Homo sapiens
tgcccagggctctgata

SEQ ID NO: 73795 - DNA, 16 bp, Homo sapiens
gcccagggctctgatg

SEQ ID NO: 73796 - DNA, 19 bp, Homo sapiens
ccatcgcatgctcaataca

SEQ ID NO: 73797 - DNA, 17 bp, Homo sapiens
tgcccagggctctgata

SEQ ID NO: 73798 - DNA, 16 bp, Homo sapiens
gcccagggctctgatg

SEQ ID NO: 73799 - DNA, 19 bp, Homo sapiens
ccatcgcatgctcaataca

SEQ ID NO: 73800 - DNA, 19 bp, Homo sapiens
tcccaaaacctggagacta

SEQ ID NO: 73801 - DNA, 18 bp, Homo sapiens
cccaaaacctggagactg

SEQ ID NO: 73802 - DNA, 19 bp, Homo sapiens
tcatggcatcttccttcaa

SEQ ID NO: 73803 - DNA, 15 bp, Homo sapiens
gccttggggcacatg

SEQ ID NO: 73804 - DNA, 15 bp, Homo sapiens
gccttggggcacatc

SEQ ID NO: 73805 - DNA, 24 bp, Homo sapiens
ggaatttatggcagttttaaacat

SEQ ID NO: 73806 - DNA, 22 bp, Homo sapiens
gcagtcctgaacaaagtagatg

SEQ ID NO: 73807 - DNA, 23 bp, Homo sapiens
cgcagtcctgaacaaagtagata

SEQ ID NO: 73808 - DNA, 22 bp, Homo sapiens
cgtgcatgttttgaaaaatgta

SEQ ID NO: 73809 - DNA, 20 bp, Homo sapiens
gcgctctgttcctttgtatc

SEQ ID NO: 73810 - DNA, 20 bp, Homo sapiens
gcgctctgttcctttgtatt

SEQ ID NO: 73811 - DNA, 22 bp, Homo sapiens
cctttctcctgcagaaataaga

SEQ ID NO: 73812 - DNA, 16 bp, Homo sapiens
cactggagaatgcaca

SEQ ID NO: 73813 - DNA, 16 bp, Homo sapiens
cactggagaatgcacg

SEQ ID NO: 73814 - DNA, 19 bp, Homo sapiens
gtgttcctggctcacagaa

SEQ ID NO: 73815 - DNA, 21 bp, Homo sapiens
cacaccagcaatgatgaaact

SEQ ID NO: 73816 - DNA, 19 bp, Homo sapiens
caccagcaatgatgaaacc

SEQ ID NO: 73817 - DNA, 16 bp, Homo sapiens
ggcgggttccagacaa

SEQ ID NO: 73818 - DNA, 17 bp, Homo sapiens
catcttgcccacagcaa

SEQ ID NO: 73819 - DNA, 17 bp, Homo sapiens
catcttgcccacagcac

SEQ ID NO: 73820 - DNA, 20 bp, Homo sapiens
gaagtgggcactgaacaact

SEQ ID NO: 73821 - DNA, 20 bp, Homo sapiens
cagggatgttattatggtcg

SEQ ID NO: 73822 - DNA, 21 bp, Homo sapiens
tcagggatgttattatggtca

SEQ ID NO: 73823 - DNA, 19 bp, Homo sapiens
ctgtctgggtgggaatgta

SEQ ID NO: 73824 - DNA, 19 bp, Homo sapiens
gcattaactgctcctgggt

SEQ ID NO: 73825 - DNA, 18 bp, Homo sapiens
cattaactgctcctgggg

SEQ ID NO: 73826 - DNA, 23 bp, Homo sapiens
caacacacgagctacaaactaca

SEQ ID NO: 73827 - DNA, 25 bp, Homo sapiens
aagatatcaatgtttctgtctgttc

SEQ ID NO: 73828 - DNA, 25 bp, Homo sapiens
aagatatcaatgtttctgtctgttt

SEQ ID NO: 73829 - DNA, 21 bp, Homo sapiens
atcactggttccttcaactgt

SEQ ID NO: 73830 - DNA, 16 bp, Homo sapiens
cgctcagtaacctgcg

SEQ ID NO: 73831 - DNA, 17 bp, Homo sapiens
gcgctcagtaacctgca

SEQ ID NO: 73832 - DNA, 19 bp, Homo sapiens
ggtctgggcctttcataag

SEQ ID NO: 73833 - DNA, 20 bp, Homo sapiens
ctcatagcttgaccttcgag

SEQ ID NO: 73834 - DNA, 20 bp, Homo sapiens
ctcatagcttgaccttcgaa

SEQ ID NO: 73835 - DNA, 22 bp, Homo sapiens
actcctcatcagtcacagacac

SEQ ID NO: 73836 - DNA, 15 bp, Homo sapiens
cttcgtcgcaatggc

SEQ ID NO: 73837 - DNA, 17 bp, Homo sapiens
ttcttcgtcgcaatggt

SEQ ID NO: 73838 - DNA, 22 bp, Homo sapiens
gcaatttctgcacagaaatatt

SEQ ID NO: 73839 - DNA, 23 bp, Homo sapiens
gatgagatcaacacaatcttcag

SEQ ID NO: 73840 - DNA, 23 bp, Homo sapiens
gatgagatcaacacaatcttcaa

SEQ ID NO: 73841 - DNA, 21 bp, Homo sapiens
cctgaagctcgttttgaataa

SEQ ID NO: 73842 - DNA, 20 bp, Homo sapiens
cacagtcaaagaatcaagcg

SEQ ID NO: 73843 - DNA, 21 bp, Homo sapiens
tcacagtcaaagaatcaagca

SEQ ID NO: 73844 - DNA, 21 bp, Homo sapiens
ccgtttgaattttccaataag

SEQ ID NO: 73845 - DNA, 15 bp, Homo sapiens
gagcgagggctcagg

SEQ ID NO: 73846 - DNA, 15 bp, Homo sapiens
gagcgagggctcagc

SEQ ID NO: 73847 - DNA, 20 bp, Homo sapiens
cctccctggagaatactgtg

SEQ ID NO: 73848 - DNA, 16 bp, Homo sapiens
cctttccccaaacagc

SEQ ID NO: 73849 - DNA, 16 bp, Homo sapiens
cctttccccaaacagg

SEQ ID NO: 73850 - DNA, 19 bp, Homo sapiens
catctcagcctccttacca

SEQ ID NO: 73851 - DNA, 21 bp, Homo sapiens
cgtctccaggaaaatcataac

SEQ ID NO: 73852 - DNA, 21 bp, Homo sapiens
cgtctccaggaaaatcataat

SEQ ID NO: 73853 - DNA, 25 bp, Homo sapiens
tgagttattgctacttcagaatcat

SEQ ID NO: 73854 - DNA, 16 bp, Homo sapiens
agcagctccgagtcca

SEQ ID NO: 73855 - DNA, 16 bp, Homo sapiens
agcagctccgagtccg

SEQ ID NO: 73856 - DNA, 17 bp, Homo sapiens
ggcccacaaggtgaaat

SEQ ID NO: 73857 - DNA, 14 bp, Homo sapiens
tgtgggccaggacg

SEQ ID NO: 73858 - DNA, 15 bp, Homo sapiens
ctgtgggccaggacc

SEQ ID NO: 73859 - DNA, 19 bp, Homo sapiens
acccaccaggacctaaaag

SEQ ID NO: 73860 - DNA, 19 bp, Homo sapiens
cattcaatgcaatacgtcg

SEQ ID NO: 73861 - DNA, 20 bp, Homo sapiens
ccattcaatgcaatacgtca

SEQ ID NO: 73862 - DNA, 16 bp, Homo sapiens
tggtcctggcctgaac

SEQ ID NO: 73863 - DNA, 24 bp, Homo sapiens
ttgttaacatatacttactggaga

SEQ ID NO: 73864 - DNA, 23 bp, Homo sapiens
tgttaacatatacttactggagg

SEQ ID NO: 73865 - DNA, 21 bp, Homo sapiens
tgcctcttctttatttatgtc

SEQ ID NO: 73866 - DNA, 18 bp, Homo sapiens
ctgaggacccttggagac

SEQ ID NO: 73867 - DNA, 18 bp, Homo sapiens
ctgaggacccttggagaa

SEQ ID NO: 73868 - DNA, 17 bp, Homo sapiens
gctcaccagccctgaag

SEQ ID NO: 73869 - DNA, 16 bp, Homo sapiens
accggcacaaggagaa

SEQ ID NO: 73870 - DNA, 16 bp, Homo sapiens
accggcacaaggagac

SEQ ID NO: 73871 - DNA, 21 bp, Homo sapiens
tgcccttgtcactttctgtat

SEQ ID NO: 73872 - DNA, 16 bp, Homo sapiens
ccacttcgggttcctc

SEQ ID NO: 73873 - DNA, 16 bp, Homo sapiens
ccacttcgggttcctg

SEQ ID NO: 73874 - DNA, 17 bp, Homo sapiens
ccctggcttcaacatga

SEQ ID NO: 73875 - DNA, 15 bp, Homo sapiens
ccctctccagcggga

SEQ ID NO: 73876 - DNA, 14 bp, Homo sapiens
cctctccagcgggg

SEQ ID NO: 73877 - DNA, 20 bp, Homo sapiens
ccaaagcagggttcactacc

SEQ ID NO: 73878 - DNA, 17 bp, Homo sapiens
gcccagataccccaaag

SEQ ID NO: 73879 - DNA, 17 bp, Homo sapiens
gcccagataccccaaaa

SEQ ID NO: 73880 - DNA, 16 bp, Homo sapiens
gcggcttcagcagatc

SEQ ID NO: 73881 - DNA, 18 bp, Homo sapiens
cctctgaggcctgagaaa

SEQ ID NO: 73882 - DNA, 18 bp, Homo sapiens
cctctgaggcctgagaag

SEQ ID NO: 73883 - DNA, 22 bp, Homo sapiens
gtcctgattcctcatttctttc

SEQ ID NO: 73884 - DNA, 15 bp, Homo sapiens
gcgctggtttggagg

SEQ ID NO: 73885 - DNA, 15 bp, Homo sapiens
gcgctggtttggaga

SEQ ID NO: 73886 - DNA, 22 bp, Homo sapiens
tggcacaggcagtattaagtag

SEQ ID NO: 73887 - DNA, 18 bp, Homo sapiens
tggtctgttccctggaca

SEQ ID NO: 73888 - DNA, 17 bp, Homo sapiens
ggtctgttccctggacg

SEQ ID NO: 73889 - DNA, 19 bp, Homo sapiens
tgcggtcacactgactgag

SEQ ID NO: 73890 - DNA, 16 bp, Homo sapiens
ccgcttccgagcagtt

SEQ ID NO: 73891 - DNA, 16 bp, Homo sapiens
ccgcttccgagcagtc

SEQ ID NO: 73892 - DNA, 22 bp, Homo sapiens
cgtcaacatcctctttgaagaa

SEQ ID NO: 73893 - DNA, 18 bp, Homo sapiens
acttctggggcttaggaa

SEQ ID NO: 73894 - DNA, 18 bp, Homo sapiens
acttctggggcttaggac

SEQ ID NO: 73895 - DNA, 18 bp, Homo sapiens
ttcaccgggaactcttgt

SEQ ID NO: 73896 - DNA, 20 bp, Homo sapiens
tcaagaggacagtgatggtg

SEQ ID NO: 73897 - DNA, 20 bp, Homo sapiens
tcaagaggacagtgatggtc

SEQ ID NO: 73898 - DNA, 24 bp, Homo sapiens
tggttagaatctgtgaaggaacta

SEQ ID NO: 73899 - DNA, 17 bp, Homo sapiens
ccccgcagagaattacc

SEQ ID NO: 73900 - DNA, 17 bp, Homo sapiens
ccccgcagagaattacg

SEQ ID NO: 73901 - DNA, 16 bp, Homo sapiens
acgtcgctgtcgaagc

SEQ ID NO: 73902 - DNA, 19 bp, Homo sapiens
tggctgttccagtactcct

SEQ ID NO: 73903 - DNA, 18 bp, Homo sapiens
ggctgttccagtactccg

SEQ ID NO: 73904 - DNA, 24 bp, Homo sapiens
ttcctggagagatacatctacaac

SEQ ID NO: 73905 - DNA, 14 bp, Homo sapiens
ggcactgcccgctt

SEQ ID NO: 73906 - DNA, 14 bp, Homo sapiens
ggcactgcccgctc

SEQ ID NO: 73907 - DNA, 21 bp, Homo sapiens
cgcttcctggagagatacatc

SEQ ID NO: 73908 - DNA, 15 bp, Homo sapiens
cagtgccggacagga

SEQ ID NO: 73909 - DNA, 15 bp, Homo sapiens
cagtgccggacaggg

SEQ ID NO: 73910 - DNA, 15 bp, Homo sapiens
ccgcccggcactaag

SEQ ID NO: 73911 - DNA, 20 bp, Homo sapiens
gctcgtagttgtgtctgcat

SEQ ID NO: 73912 - DNA, 20 bp, Homo sapiens
gctcgtagttgtgtctgcac

SEQ ID NO: 73913 - DNA, 20 bp, Homo sapiens
cgcttcctggagagatacat

SEQ ID NO: 73914 - DNA, 19 bp, Homo sapiens
gcattttcactccgaagtt

SEQ ID NO: 73915 - DNA, 19 bp, Homo sapiens
gcattttcactccgaagtc

SEQ ID NO: 73916 - DNA, 25 bp, Homo sapiens
catgactagctctcattttgattag

SEQ ID NO: 73917 - DNA, 16 bp, Homo sapiens
gacatgggggagtcac

SEQ ID NO: 73918 - DNA, 16 bp, Homo sapiens
gacatgggggagtcat

SEQ ID NO: 73919 - DNA, 18 bp, Homo sapiens
gcatctcgggttctactt

SEQ ID NO: 73920 - DNA, 20 bp, Homo sapiens
agatcactaggagggtcctc

SEQ ID NO: 73921 - DNA, 20 bp, Homo sapiens
agatcactaggagggtcctt

SEQ ID NO: 73922 - DNA, 23 bp, Homo sapiens
ggttctcctggatgaaattacta

SEQ ID NO: 73923 - DNA, 20 bp, Homo sapiens
ttctaccttgggtcccttac

SEQ ID NO: 73924 - DNA, 20 bp, Homo sapiens
ttctaccttgggtcccttat

SEQ ID NO: 73925 - DNA, 19 bp, Homo sapiens
ttccagcccatattctgaa

SEQ ID NO: 73926 - DNA, 18 bp, Homo sapiens
tggtgctggagaattcag

SEQ ID NO: 73927 - DNA, 18 bp, Homo sapiens
tggtgctggagaattcaa

SEQ ID NO: 73928 - DNA, 21 bp, Homo sapiens
ggtgtctcccaactttatgtg

SEQ ID NO: 73929 - DNA, 21 bp, Homo sapiens
gtgaggagggatttgaattat

SEQ ID NO: 73930 - DNA, 21 bp, Homo sapiens
gtgaggagggatttgaattac

SEQ ID NO: 73931 - DNA, 24 bp, Homo sapiens
aaaaaagtctgcactcaattctac

SEQ ID NO: 73932 - DNA, 15 bp, Homo sapiens
aggccgtcactgtac

SEQ ID NO: 73933 - DNA, 15 bp, Homo sapiens
aggccgtcactgtat

SEQ ID NO: 73934 - DNA, 20 bp, Homo sapiens
ccatttcctcccaaatacat

SEQ ID NO: 73935 - DNA, 15 bp, Homo sapiens
ccgcagaggtgtggg

SEQ ID NO: 73936 - DNA, 15 bp, Homo sapiens
ccgcagaggtgtggt

SEQ ID NO: 73937 - DNA, 18 bp, Homo sapiens
cattttgcggtggaaatg

SEQ ID NO: 73938 - DNA, 18 bp, Homo sapiens
ggttcccgaggaaagaag

SEQ ID NO: 73939 - DNA, 18 bp, Homo sapiens
ggttcccgaggaaagaaa

SEQ ID NO: 73940 - DNA, 19 bp, Homo sapiens
cctcctcgctcaccttaaa

SEQ ID NO: 73941 - DNA, 21 bp, Homo sapiens
gagtggccctatcaaatgtta

SEQ ID NO: 73942 - DNA, 19 bp, Homo sapiens
gtggccctatcaaatgttg

SEQ ID NO: 73943 - DNA, 21 bp, Homo sapiens
tttgttgtgcctgatgatgta

SEQ ID NO: 73944 - DNA, 18 bp, Homo sapiens
tgcaaatactgccaacca

SEQ ID NO: 73945 - DNA, 17 bp, Homo sapiens
gcaaatactgccaaccg

SEQ ID NO: 73946 - DNA, 23 bp, Homo sapiens
gaggcagtgttgatttaagaaga

SEQ ID NO: 73947 - DNA, 22 bp, Homo sapiens
cctggtttcactgtagtcactc

SEQ ID NO: 73948 - DNA, 22 bp, Homo sapiens
cctggtttcactgtagtcactg

SEQ ID NO: 73949 - DNA, 18 bp, Homo sapiens
tggccacaggaatctgtc

SEQ ID NO: 73950 - DNA, 20 bp, Homo sapiens
cgcatccagaacattctatg

SEQ ID NO: 73951 - DNA, 20 bp, Homo sapiens
cgcatccagaacattctatc

SEQ ID NO: 73952 - DNA, 20 bp, Homo sapiens
gcagcttcccatcatacact

SEQ ID NO: 73953 - DNA, 22 bp, Homo sapiens
gtgcattctgcttttaactcat

SEQ ID NO: 73954 - DNA, 21 bp, Homo sapiens
tgcattctgcttttaactcag

SEQ ID NO: 73955 - DNA, 20 bp, Homo sapiens
gcaattgcctgctcattagt

SEQ ID NO: 73956 - DNA, 25 bp, Homo sapiens
atgacaagtctctgaataagaagtc

SEQ ID NO: 73957 - DNA, 24 bp, Homo sapiens
tgacaagtctctgaataagaagtg

SEQ ID NO: 73958 - DNA, 22 bp, Homo sapiens
tgaatgctttgatcacatgagt

SEQ ID NO: 73959 - DNA, 18 bp, Homo sapiens
acagtcaggtggatctcc

SEQ ID NO: 73960 - DNA, 19 bp, Homo sapiens
cacagtcaggtggatctct

SEQ ID NO: 73961 - DNA, 20 bp, Homo sapiens
cacattcctggaggtgctag

SEQ ID NO: 73962 - DNA, 17 bp, Homo sapiens
ccccaacccaagagaaa

SEQ ID NO: 73963 - DNA, 17 bp, Homo sapiens
ccccaacccaagagaag

SEQ ID NO: 73964 - DNA, 18 bp, Homo sapiens
tccagggctgcttacttc

SEQ ID NO: 73965 - DNA, 13 bp, Homo sapiens
cgcgcgctaaccg

SEQ ID NO: 73966 - DNA, 13 bp, Homo sapiens
cgcgcgctaacca

SEQ ID NO: 73967 - DNA, 18 bp, Homo sapiens
cgtccgtcatggatcaga

SEQ ID NO: 73968 - DNA, 18 bp, Homo sapiens
gcccagagacaggaaaat

SEQ ID NO: 73969 - DNA, 18 bp, Homo sapiens
gcccagagacaggaaaac

SEQ ID NO: 73970 - DNA, 16 bp, Homo sapiens
gcctgccctctgttca

SEQ ID NO: 73971 - DNA, 15 bp, Homo sapiens
agggatccgcaaagc

SEQ ID NO: 73972 - DNA, 16 bp, Homo sapiens
cagggatccgcaaaga

SEQ ID NO: 73973 - DNA, 20 bp, Homo sapiens
tctttctgccaggtacatca

SEQ ID NO: 73974 - DNA, 14 bp, Homo sapiens
ctgctggccgtcct

SEQ ID NO: 73975 - DNA, 13 bp, Homo sapiens
tgctggccgtcca

SEQ ID NO: 73976 - DNA, 19 bp, Homo sapiens
actcacgcttgctttgact

SEQ ID NO: 73977 - DNA, 21 bp, Homo sapiens
ccttgaaagatctccctcttt

SEQ ID NO: 73978 - DNA, 21 bp, Homo sapiens
ccttgaaagatctccctcttc

SEQ ID NO: 73979 - DNA, 18 bp, Homo sapiens
cgtagccccaaaggatct

SEQ ID NO: 73980 - DNA, 20 bp, Homo sapiens
ctcaggaagctaaaaggtga

SEQ ID NO: 73981 - DNA, 19 bp, Homo sapiens
tcaggaagctaaaaggtgc

SEQ ID NO: 73982 - DNA, 23 bp, Homo sapiens
cctaatatcccctccagaactat

SEQ ID NO: 73983 - DNA, 15 bp, Homo sapiens
cagcggaagccaagg

SEQ ID NO: 73984 - DNA, 15 bp, Homo sapiens
cagcggaagccaaga

SEQ ID NO: 73985 - DNA, 19 bp, Homo sapiens
ccgggagatgaagaagaga

SEQ ID NO: 73986 - DNA, 16 bp, Homo sapiens
ccgccttgcagatgat

SEQ ID NO: 73987 - DNA, 16 bp, Homo sapiens
ccgccttgcagatgac

SEQ ID NO: 73988 - DNA, 19 bp, Homo sapiens
ggagctggccattagaatc

SEQ ID NO: 73989 - DNA, 22 bp, Homo sapiens
gctcagatctgaaccctaactc

SEQ ID NO: 73990 - DNA, 22 bp, Homo sapiens
gctcagatctgaaccctaactt

SEQ ID NO: 73991 - DNA, 16 bp, Homo sapiens
tcaccccctcctgacc

SEQ ID NO: 73992 - DNA, 20 bp, Homo sapiens
ggttgtgcagagcagttaac

SEQ ID NO: 73993 - DNA, 20 bp, Homo sapiens
ggttgtgcagagcagttaat

SEQ ID NO: 73994 - DNA, 21 bp, Homo sapiens
tggctgtgttttgaaaaacta

SEQ ID NO: 73995 - DNA, 17 bp, Homo sapiens
tgcccagggctctgata

SEQ ID NO: 73996 - DNA, 16 bp, Homo sapiens
gcccagggctctgatg

SEQ ID NO: 73997 - DNA, 19 bp, Homo sapiens
ccatcgcatgctcaataca
